United States Patent 10,500,237 (COMPOSITIONS COMPRISING BACTERIAL STRAINS) - sequence listing, part 2

SEQ ID NO: 4 - DNA, 3592167 bp, Roseburia hominis (residues 1,796,085-3,592,167 of 3,592,167)
tttttcgcaatgaagcttgccacaaagagtgaaaccggcgtgattaccacgactgccaccgtgatccgcacgctgatcgtcagcatgaaaatcaacgttccgaagatggtcacaataccggtaaagaactgggtaaatcccatcagaagtccgtctgcgaactgatcaacatccgcgatcacacggcttacgatctctccgtatgaatgagcgtccagatatttcagaggaagcttttcaatcttctcgaacgcctctgtccggatatcccggatcacattgtaggtaattttattgttgcaggcattcatcacccactgtgccactgccgtcagtccgatgatgaccgccatctttctgagaatcacaaagatcccggcaaagtcaacggctccctttcccacgatccggtcgaccgcctgaccgatcagaatcggaagatacagggtaagcgccaccgtcaccgccgcgagaatgatcgatgctcccaggtatccccagtatcgtctgatgtatcgcagaaccttgcgcagcgttgatttttgattttcatttaccacttttttcatcttttcgcctctcccgcctgctgttcttctgtccgcttaaactgcgactcgtaaatctcgcggtatacctcgcagtccttaagcagatcctcgtgtgttccaagtcctacaatctctccatcgtccagcactacgatcttgtccgcctgcatgatggacgccgcacgctgcgatacgataaataccgtcatctgcccgtccatatgtgcgatggctttccgaagcgccgcgtccgtcgcgaaatcaagcgcggatgcgctgtcgtccataatgagaatctgcggcttcttcacgagcgcacgcgcaatcgtaaggcgctgtctctgtccgccagaaaggtttctgccgccctgctcgatctcataggaaagtccgccttccttggcatccacaaactcccttgcctgtgcagtctcaagcgcctcatacatctcctcgtccgtggcgtccgaattgccccagcttaagttctcacggatggttcccttaaagagaaccgccttctgcagaacaacaccgaccttcgccctgagttcctccaatgtataatcccgcacattcttcccgtcgacgagaacctctcctctggtcgcatcgtaaaaccgcggaatcagattcacgaccgaagattttccagaaccggttcctccgataataccgatggtctctccgcgtctgaccgtaaaatcaatgtcggagagcgcttcttccgatgcgcccgcataagtaagaccaaccttggaaaatacgacggcattctccgccgggattgtctcttttccttccctgcctgctccatccgaagtgagacttcccgtctccgctactggatgctccgtgatcgacgattccatgtcaagcacagtctcgatacggttcatgcaggcaatggatttgttgatgttgataatcaggttggccagcttgattaactccactaagatctgggacatgtagctcaccagcgccacaacctgtccctgcgtaatgttgccattgtccacgcggatcgctcctacccataccagaacgacgatcgctccgttgatgataatataggtaagcggattcatgagcgccgagatcttgccgacatagagctggatctttgtcagcgcctcattgtcttcgtggaactgtgcaatctcatcctgctccttgttgaatgcacggatgactctgcttccggtcaggttctctcttgtgatgcccagcactttatcgagtgccgcctgtacttttttgtacagcggaatactgaccagcatgatgccaaacacaaccaccgacagcagcggaatggtcacaacgaacacgagcgccgctttcacatcaatcgtgaatgccatgaccatcgctccaaacacgataaacggcgaacgcaagaacaggcgcagaacgaggttcaccccgttctgcacctgattaacatcacttgtcattcttgtaattaacgtcgacgttccgacggtatccatctcggtaaatgacagcgtctcaatatgttcaaacagagcatgtcttaatcctgtcgcacagccaaccgccgctttcgccgcaaaatactgcgccgtgatggcacaggtcaatccgatcagcgccaggagaaacagtaccagactcatcttcataatatatggacgatcggcatttgccaccccggtatcgatgattgccgccatgacaagcgggacaatcaattcaaatgaagcttccaggagcttaaaaagcggtcctaaaatactttcttttttatagtttcccaaatactgcaataactttttcatgatactccttcgtgtcctatgcttttaaatctttcattttctgaagtccgataatcagcgcaccgccgatcacgaaaaacaggatgttaaaatcatgaagcgtcattgccggctgcggtacctccaacgtggtcggtcccatgacaaccgcgtagattgatcctaacatcagaccgatgatcagatagatcgtctgtgcccggaaatgatctaacgccttgcggatcagctttaccacaccaaaaataccgacgagaacgccgcatccgaaaataaacaccgtcggaaatgcagcaaaattcagatgaagaatatctttgatggcagtcaccaccggcagatacagtcccatgattaaaagaagcgtcgagcccgaaattcccggcagcaccatcgcacagatggcaatcattccggcaaggaatacaaacagggcaagccccggcgtcagatgctccaggctgacaccctctccgccgctgctcggattaaagtaagtaatcgcggtcacgattgcaacgccaatcagcacaaacggaatggcagatttttttgccgcaaggcagttcttttcttccctaaagataatcggaatggcaaaaataataaatccgataaacagggaactgattgcatagatatgagcgtcaaacacgctcgcaagaatcaggatggcgagaatcattccacagacccagccggttccaagcttaatcaggaagaacagagctgctttctttttctccctgcttccggttatcagatcgtcgatagaatcaataaactggtcataaaaacccaacaggaaagcgacggttccgccggatacgccaggtacactgtctgccagtgccatgcaaaatcctctgataaactgcactaaatacatcctttatacctcatttttctgttatttttctattttattcactacaggtcaaaatctgtccaattagtggatatactgctccagcttgtgcgactcgtctaacacactgtgaagcagatccttggtattttccgcattgccgagattcttaacactgagatccgccgcctgcacagaagaagctgtaacttcctccgtcgttgcggagagctgcatgatgttctccacgatctgattgttcgccttggagaggttgtttaacatagtgtcgatctcaccgatgtccgtcacaagctcattgacattctggttcatggcgccaaagctctcggatgcctgcgcaatcatctcatcctgcgcacccgccgccgtcacagaacgctccaccgcatccgccgccgtctgggcattttcagacagctgctctaaaatgttggcaatattctccgtctcctgcctggtcttctccgccagctgacggatctcgtctgcaaccaccgcaaaacctcgtcccgcctcgcctgctctcgcactctcgatcgatgcgttgagcgccagaaggttggtctgactggaaatagaaaaaatggtatctgcaatacttttgacagcgcttgtacgatcctggagttctctcatagaggaagccacctcggagtttgtctgtgcaataactgcggactgcttcttcagatcatccatgattctggaactcttctcattcagctctccggactgcttcgccacctgtaccatcttctccgaacgctctaacgtcgttccgatggagtcctgaatattctgcgtcatctcggtctgcgtctggatattctcggcggtactctgtgtactgtccgaaatatccttcatggcaccgttgactacctcggtggaactattcagttcattgacaatattcatcgcattctctgttcccttgcgcacctgatctgcaaccgcaatgatatcgtccaccatctggcgctgtgctgcttccttttctgtcaggctgccaatcgtatcgcggttgaactggtacgccacggatactgtcagataaaccactaccatcataagtataattgccagcgtcgcacaccactgatccagtgcattctcgccctggtatgtgtgaagcgccagcgtctttgacgccgtcacaagaagattcaccgccgatacagcaatcccggaaaaggcggcaaactttttatcgtaaaacagaatacatgcaaccaacggaattgcagccataaaacgcacataataattgtcaaacgcccatcccatcacaaacgtaatgacaagcagcccgaccgtcgcaatatagcggatcttcggatcatcttttctccgctggtacaacacgagtgttcccgctgttgccagaataatcaataccgcgatcataacggtatatccaactgtgcggattcctctgaggcaggcaattcctaccacacaaagcacacagagataaaacacgatatatccgatagccaggaaatgattggcacgtttattctgttccacagtatctgcatacaaatgcttctgttcctttttctccataactttcacctttcttctttcgataactccatataccatttcaatatatcatactttatccggcatgaataatattttttcaatttttatttcttttttgatgttttatctgtcccttttccacagtctgtggcaatttcgcctcgcagcatccacagacagagcagattcggcagagccatcagggaattcagcagatccgatatcccccacacaagctccatggaaagcaccgctcccagataagcgaaaaacatgtacgccacctggtagacacgcacccccgcctcgccccacaggtagcgcaccgcgcaggttccgtacacgttccagccgatgatcgtggcaaacgcgaacagcgtcagagagatcgagagcatccactcaccgccgacgggcaattcccggaatgccacaaaacacatattttccggtgccactccccggtattcctgcggatggcttaccatgctgccgaccgccgcaattcccgtgatcgcacataataccaccgtgtcccagaacggtcctgtcatggagattaacgcctgccgcacagccgcctccttcgggctgtcagaggaggatgctgccgtcgccgcgaccatcggaatcgagccaagccctgcttcattggtaaacaatccccgggagactcctgtctggatgccaagaagcagcgctccgccggtgcagccgcccgccaccgccttcgggcagacggcggatgagagaatcagcgctaacgtctccggcagcaccgccctgtttcttcctataatatagagacagccgcccacataaaaagcgctcatcagcgggacgagccacatacacacctttgcaatctggctgtttcccccgatgataataatccctgcaagccccccgaccgccattccgaccagatgcggcgacacggtaatctgatgctggagcgccgtgcgtatggagtatgactgtacgctgcttccgataccaaacgatgccagcagcgtacatacagcaaacgccgctgccagttttctttttttcagacgccgatccaaaatatacatcggtccgccggcaaacgtactgtctgtcctgcgcacccggtatcttatagagagataacattccgcatagcaggtcgcaatcccaaataccccggtcagccagcaccagaataccgctcccggtccgccgatggcaatggctgtggaaattcccacaatgttacccgtaccgatcgtcgctgcaagtgccgtcgccagcgccgaatacggtgttacctgatccttttcctgattcttcgttccggtcagtgacaaccggattcccaacgggatttttttctggatgaagcccaggtgaaatgtgaaatatagatgtgttccgaataagagcgcaagcatgggaaatccccacagatattcccgcgccaccgccaccgcatgctgcaataatgccataaaaattccccatataccctgcatcacaaatatctgtaaagtatatggggaatctgtttttcccatgcattcgattgttctatgcttctaccagatgtgcgattgcatgtaccagctccttgatgtcatagttggaagtattgatacacagatcatagttgagacggtctccccaggtctgtccggtaaagaactgatagtaacgcgccctgcgcttatccacgtctaaaatatggcgctttaattccttgtccgtaaagtgctcgctctccggcgcgcgcttcttgcagcgttccatcttgtgctccatctccgcatagacaaacaggcggaacggatgcttctcgcgcaaaatataatcggcgcttcttccgacgatgacacaatcggacttctccgcaaattcctgaatcaggcggctctgctcacggtagatcgcattattctgctccatgattggatcaactcccatgtaaaagcttctcccgatcgtaatcggatacaacgtcgacggaccgttctccatcacatgctgcacatagccctccgccagcttcgtacggtctgcaatctgactgatgatctcattatcgtaataagcaattcccagctcatcggacaatctctttccgatctcacgtccgccgctgccaaattctcgtccaatcgttataatcctagacattggtatctcctttcccctgtgtggggtttgtttttctatctaaaactatagcatttcttcctgcggttcgcaactgcaaaagctgccgccgcagataatagccgatccctgccgcatcatctgcgtctgtttgcctccctgacgccttttcttcccggcacttacttattcaagaaacggtcccaggatgccgtattgtgtgtgccggacaccgcaagcacatactcctcctcatcgggcgcatcgatctcaaatatatagttctccccgtcccgctttaacgcatagagtgtgccgtccgcaaaggagcggatcgtctcgttccacgccgcctcattgaccatctcatcctcgcaggttcgcatcagtatgccgttggcatcgtagaccttgtatccctcccgcaccagggaccggatcaccggctcctcgatctttaacaccagatcgttcgcgcgcatctcgcggatatccctgttgcaggaattctccggcagtatcgtcacgtttgatagtgtcatatggaaaaatccgcccgtcacctgcacgtcggcaatgtaagcctccgtgaaagaaaaatgttccagttcatccgttgtcgtatatttcatagtgttcctccgtatctcttccctgttatttctcctcccctattatacagagccgtccccgttttttccaccaaaaagagtaacattgtctatgtctccggcatggaaatcttatcgagaatccccgtcagatgcgcgatcgtcacgccgtagttcgtcatcggaacgccctgctctctggcgcgctcaatccgcgacatcacatatttgcggttaaacatgcacgcaccgcactggatgatgagatcgtagccggagagatcttttgggaagtccgtcccgctcacaatatccacagcaaccgactcaccgaagcgttttctcaacatccgcggaatcttttctcttccgatatcctccttcagcggtgcatgggtacagcactccgcgatcaataccctggaatgggcgttcagcgcgtcgatatgcctcgcaccctccacatagtacggcagatctcccttatacgctgcaaacagcacggaaaaggacgtaagcatgctctccgccggtttgttttcgtagacatagccaaatacctgggagtcggtaatgataagcttcggtgctttttttaataccgcaagcgccgggatcagctggtcggtcgtcacactcatgaccaggcatttcttatcgagaagttcgcgcagggtctgtacctgcggcagaatcagccttcccctgggtgcctggatatcctgcggcatcacgagaagcaccagatcctcccggccgaccagtgtcccggtgatgaggcggctgccgtaattctccggcagtttgcggatcaatgcttcttttaatgcctccatgccctctcccgtcttggcgctgaccggatatgcctcctcaccggtcttcccccggatggcggctgccagtttatccacctgtgcgtccgaccggatgtccgttttccccacgacgaaaagtaccggcgtcccgtgctctttcaaaaagcggtaccagtgcatttcttcctcatcaagcgccgcgtcaccattccccgccacaaggagcagcgcaatatccgtcttttccgctgcgagacgtgtcttttccatgcggcttttgcccagttcgctctcgtcgccaaatcctgccgtatctatgataatgcacgggccgagcggatgtacctccatcgccttgtagaccgggtcggtcgtcgttcccgccacattggcgacaatggatacctcctgtccggtaaaagcgttgatgagtgcggatttcccgctgtttgtttttccaaatattcctatgtgcagacggctgctgcccggcgtctcattcaatgtcactgccataactttctttttccttcctgcatacgaatttccccttgtccgtattacatccatatccggcttccagcggctgcccgatcccagcatcgcttccggctatcagaagcggaagtctctctttccctctgcaatatcatgaatgtgctcgtaggcggtctgctttaccttcggattcggaatcttctcaagctcacggtcaatcagttccataccgatctttttcgtctcctcgcccgcataatcctcgaggtattcttttaaggtcatgagcgcgttcggatgacagcagtttaagatctgcatatttttgcagagcgccataaaacggtcaccggttctaccctcgcggtaacatgcggtgcagaagctcggaatatagcccattttcatcagccagttcacgacctcatctaaggtacgctgatcgctgacgtcaaactgctcggaattctcctcctccggctccggctcggcataaccgccgacactcgttctcgatgcaccgctgatctgcgatacgccgagcgggagcactttctcacgcactgcctgactctcgcgtgtggagatgatcattcccgtatacggcaccgagatgcggatgagcgcacagatctttgcaaaaatatcatcgctgataccgttgtcaaaagcagtcggatcaatgtcatcggcatgtttgacacgcggcacgctgatcgtgtgcggtccgacgccgtgcacggcttccagatgctccgcatgcatcagaagtccggcaaattcatagcggtacatctccagtccgaacaacacgcccagtccgacatcatcgatgccgccctccatcgcacggtccattgcctccgtgtggtacgcgtaatcatgcttcggtccggtcggatgcaggttctcataactctccttgtggtaggtctcctgaaacaggatgtaggttccgattccggcttcttttaacttgcggtagttctcgaccgtcgtcgccgcaatattgacgttgacacggcggatggctccgtttttgtgcttgatactgtagatcgtctgaatacactccagaatatattcgatcggattgttcaccggatcttcgccggcctcgattgccagacgcttgtgccccatgtcctgaagtgccgtgacttccttcacgatctcctcctgtgtcagcttctttctggctatgtgcttgtttttcaggtgatacgggcagtatacacagccgttcacacagtagttggaaagatacagcggtgcaaacagcacaatacggttgccgtaaaagtctttcttgatctgctgcgccagcgcatagacttcctcgattttttccggaatctgacaggcgagcagcaccgatgcctctctgtgatttaagcccttgcgctctcccgcttttgcgatgatcgcgtcgatcagctccacattgtccttgttcgcatccgcgtaggcaagcgtctcccggatctcctcatcgttgataaattcctctgcttttaatgattttgcgtcatacttgtacataatttttcctttctttccggtcagttcatgcttcccggtcagtgtttttatttttattgtaaaccgcaggacggtaatccccgcggtcggtaaccacttcatagccgatgctctccatccgcctctgcatgcagaaacgacattctgccgcctcatcccccgtgcagatcttattgtcgtaaagcttatatttttcccgcacggaaaccggcgagagattcggcatcaccacattggcgccggacagaattcccatttcccttccctgcgggtggatcgtgccgagcgccgtcgtcgccggaagcagcacatgcggattcatcagccgcaggatggaaagcagccgcagggtcatctccaacgtccccgcagtctccccgccaaacggcgtgtccttctgcgggatgaacggcccgattcccaccatggcgggtccgagctccttaataaacatcagatcttcatacagcgtctccgtggtctgatacggtgagcccaccataaagccgcagccggtctgatatccgatctcctttagatcccgcagacagcgcatccggtttttaagggacatttcctccgggtgcagctttccgtagtgcaccgtatccgccgtctcatgcctgagcagataccggtctgcgcccgcgtcaaaatatgcctgataactcgctctttctttttccccgatcgagagtgtcactgcacagtccgggtatgcccgcttgatcgcagacaccagaccgcagatcttctcatctgtaaaataggggtcttctccgccctgcaggacaaaggtgcggaatccaagctcataccccgccgcgcagcaggtgaggatctgctcctctgtgaggcggtagcgctcggcacatgcattgcccctgcggatgccgcagtaatagcagtcatttttacagtagttggtgaactcgatcagcccgcggatatagatctgttttccgtataccgactgtgccgccattctcgcctcagccttaagcttctcgactgtctctgtatcttctgttgtaagtagacagtccagttcacccaccgacagcatcttctccgtcttcaggtgctctatgattttttcctcgtgtgtcatataaatctccattccgcagacgcttatacattggaatagacggtctttgccgtgattcccgccagccgtccgatctttcccgacagtgcattgatgacatcctgcggtgcatcgatggcaacgctgataatgtgaacatttttttcccggtaagggattcccattctgccgatgatatggctcccgtattcgtgcagcagatgattgagctgctccacggactcggtgctttccacaatgataccgataagtgcaattcttgtctccatattttctcctaataaaaaagaatcctgcctgcaggattctccgcctgcggcgggtcgctcttgcgacatctttcgtctccgccgcagtgcgatccccgaagagtttttatataataggaacgaagtttcctattacataaaaaaaccgtatctgaaatctcccctcagatacggcactcgctggaaatacacggcagaacctgccctacagggcatggaatatcccgccggtatcctatctacagcatctgctccgcacacacagaccagatgcagactctttcatgaccgccatatcttccgccgcaggcactgcttttggcgtcagagacttttgttaaggcaagacagcaagaacgtatctcactgcaatgctgtttcagcgtatcatgaagtctgttccctttcaagatctttcgttgtattttttgtgaaacaattcacaatcttttctttttccggtggatcaaaaatcggttacacggatacgtccagagcatcgggatcagcattccgatcaccttgattgccatgtcgcacagattccccgtcagatcgttttccctcgcccaggtcgtcatcgccgatccaatccagccatttgcaaagattgtgaacagtaccatgaccgcatagagcatcatgctgactgccggattggcgtccgcattaaaagtaatcttgcggttcaatataaacgcaatcgtataacccacggtcgttgaaatcatataggtatacagatatccctttgacgtaatgccgatcaggttgagaaaatgcgcggttaccggttccaccgtaagcgcagcaaatactgtgtttaaaagcagcatatgcaccgccagctcaaccatgttggaaccgcctcccgcaagcaggaacttcataaacttccacagttccgcatgtctgtcggtccacgccgtaaatccgcttttctcctgtcgtatctcacccattgttttctccttttctgcacggtatttttcttaccgggctgcccttgttctgccgggtgctttccccatccctctacaacaacaagactgccagcacaatcacaagtgccagaaacagcaccgcttttaaaatcatcggaatcgccgcctcaaacgtggcaggtgctttgctggtcagatagtcaaataccgggcgtgacacttttttccccaccagttcctcatacgttctggtataagtatggtattcacacggctttttttcgctcaatacaatacagcgcacgccgcgcttcgtacggttgccgtagacattaaatcccgcggacggtgtaaatccaagcacaatgttccggtaacgccccacgaagttgtttttatgatcgtgtccgacaaatgccgcaagcacttccccgcactccgaaagcgcctcaaattccccggtattgacgtccggtaccgacggcggttccagaaaaatatccccggcgccgcaggtttctcccagcttataatattcgttcttatgtgtccgataagcgcgcaccgcacctttttccccacggtcaacaagctttaacacctcataatattcgcgcatcgggatatgctgaaatacgatggacggcacatacattccatttttctcccgaaggtcttcccgctgtttgcggtaccacgcaatgatcttcggatcgaatgcctcatagccgccctccctggcatccgttccgctgtcaaacagatatagttcaaacacatcccgcccgcttccgtcggatgcctcgatgggaatggcacaggttcctcccccgtcaatcccttctgcctgctccccgatgcaattcggaagccttttgtaaatatgatagaactgatcctgattggaaatcccgacctggcagtcatgattaccaaatgtcactgcaaacggaatgccacgctttgtcaccggctctaataattttccaatcgtctgtgctacctcccgctccagctcctctccttttcccttgtaagtcacaccatagcccttgatctgatcaccagtgtagacgacaagatccggctgctcctccagaaccgcccgctccatcagcgcgatcgtgtctttcgatattgcgggaatttcctgcatatctgtaatctgcatgattttaaaagtaccgtctttttgaaatctcaatttcatccttattctccgtggtgtaaaaaagggagactgcgcccctgcatgtctcccttgaccttttcttagttatcttcccaaaaatgctgttccagatctgccgataatgatgaaatctcatcgatttcagccgaaatgctgcggatggaatcattctgcgacgtgattgtgtccgtgatattctggatggttgcagaattttcctctgaggttgccaccagcgtctcgatctcctgctggatatttccaaagtgttccttcacatgttcaatgatcttatattcttcatcgacaatctggctcgcctcatccgtcgcatcattgatgttactaaaataatccatcaatccgccgaccagctccacactcgcggaagcagcatcggtgcccgccgtgatttcttttgagatctgcccggtcgtatccgtcagccaggtcaaaatctcctgaatgttgttcgccgccttggcactctcttctgacagcgcgcggatctcatctgcaaccaccgcaaatcctcttccgtgttctcccgcacgcgccgcctcaatagatgcatttaacgacaacagattcgtctgggatgcaatggaattgatctctccgagaatcgatgtgatccggttcatctcggtaagcagcgaatcggtcgattggcgcgcggaatcgacggtctcctccatggaaagaatggaactctttgccgtctgtatcgctccgtttcctttttctaccgcactctgcaccttctgaaatccctgatccagagaaactgccagttcatggttccggttaatctctgttgttgccgcattaattttatccatcacgctgacagttgcattagcagtatcctcaaccacctgccccatctgcgatgccgccgatttcacgctggagctgccgtccgcaagcgcatgcactgaactcatactcttgtggatcgtggtgttcagattcgctgaaatcgtattggcgactttcgcattgttctgaacgatggaaagcgtctcttccgttttcttcacaacacccgcaccgcgcttcgtcgcaaaataaagcaggatcgctgtcacgataaacaaaaatatacgcgtcacgaccccggccatcgtgtagtcaattcccgcgatggtctcggggctgaaagccatgaatacgaccgaaataacggcaaacggcactgcgaaatagatgataaccgactccataaaataggaagttgtcatcgctaaaagtacaaaattcgccagatacggaatcgaattgccaccatatacccacgaatacaacagcgtaccgatcgccggcggaaatacaagaatcagcacttttttcgcatcgtcaatcggaaggtaacatccaatcgtagaaataattcccgcaactaccagaattgcaattccacggattgcaagcacggtaaatccgtatcccatcaaagaaacaaggctaagtgcaataatcgagcaccagacaataaccaaattctgcctgtgcaatttttccatatcatgttcccttctaaagaaaacctatcatcatgtacgcgtctattatatcatctttttgcgctgctttctgcacatccgaagttccaccggaacttctaatatgaatccggtaggattcattatgtcatctttttgcgctgctttctgcgcacaatatgaactcgtcagagttcattataccgcaagatcagatcaagaacaatattgcaacttcaggctttttcggtaacttcaggctttttcggtaaatcctgaggttgacacgatgttttcggtaaattctgggacggacaacagtttctgcaacccctaggcggcgtgatcttttcttctttttcgggtctaacgtggcgttttccttcttccagacccggctacgacttatttttcggcgttatgtaaacttctttctctcccgcaagggtctagcgcgtgaaaatcagtctctcggacccggcttgtctttcttcccgggtctggcgcggcattttctttctcccagacccgaccatgacttgtttttggcgttatgtaaacttcttttcctcccgcaagtgtctagcgcacgaaaaatgggctcccagacccggcttttcttccttcccaagtccagcgcacgaaaatcaggctcccagccccaacttttcttcctccccgcatccagcgcacgaaaatcagtcacacagcccgtccaaagctcgtttttcgtcattatgtaaaccttttttcacgcgccacgcattacaacgttccaaacgaatacccctgcgtctgcgccgcatcgatcagatctcccagcaccgccgcatttgttgccgactccgcatgcagcagatagatggctcccgggtgcatcttatttttcatcttctgcaggctttccgcctgatccggctggttgtccacatcgtaatccaggtaggcaaaactccagaacacgctctcgtatccgcagttatttacaacggcgagcgactgctcactgaactttcccgcaggatagcggaacagattcatctcatatccaaaggtatctttgatatactggtggtttcccatgacctcttcctgctgctgttccactgtcagcgaagggattcccgccgacgggtgcgtcacactgtgattgccgactacatgcccctcgtcaatcatgcgctgcaccagtgccggttccgcctttgcataaggctccgtgacaaaaaagacggcatgcacgcccttttccttaagcgtatccagaatggattccgtgtacccgtattcatatccctcatcaaaagtcagatagagggtctttgtattctctccaatgaaaagcgcatggtaatccccatacttctgctgcgcactgactgcatcgttcgggcggttgtccgcatcggtgtggcttcccagcccccagctctgcacggtggtatccagcccgtcaagcgcaatcgtctgcaccgccgcatttccacctgcagcactctgaccgtctccggtgctgcttcctgtttggtccgccctctgtccgtctccggtgtcatttcccgttccatccgtgccctgatcgtctccggcgccgtctcccgttccatccgtaccttgaccgtctccggtgccgcttcccgcttcgcctgcgccctgaccgtttccatccgtaaccttgttggcacggtatgtctccgccgttgcaagcactgcgtcaccgatggcggcagcgtacgcatccagcttttcatcgaaaagctggttatcggatgcatcgttgataaatcccatctcgacgatgcaggacggcatgtccgaatgtacattgatataataattggaggattctccagtctgggttccctttttcacgccgcggtttctctggattcccgccgtatccagcacttccataatgtggtttgcgagggcatccgtctcctccgaaccactcgccgagatccaggtctctacgccgttaccctcgccgtcattgcggtgcagcgacagcatataatccgcaccgctctgattggcaatcccgcaccgctctgacaggcgcaaaaacgtgtcatccgacctcgtcataaccacttttacatttttatcagccaaataagctgacacagcctgtgccagctttaaattatcatccttctcataacgccccttataatcggagccgttgtcttttccgccatgtccggcatccacgcacacgatcaggggattctcctctgttttcgtctcctccgaccagattacctctccctcaatctcctgcgttgcagactgcgttccctgcatcagggacagcccccgtcccaacagttcaaaccctgcgatcacgagcagcattttcacaatactgtactgtatacataccagattccgaattcgtcttttctgtctctttgttacattcacatcacttcactccttggattcctacgattctattttagtcctctttccgtgaaaacgcgaatgaatctttatgaagaatttcttaatatgaatccgtccggattcatcgttctaaagtaaaaactgtgccagagcgtaattgctcacatcctgcccgcgttccgtcaaataaatcctccccgcgcgtttttcgagcagtccttcctccgtaagatgcagcagcacctcctgatacactgcctcaatctgtgttccaaacgtctgtgcaaaacgttccctggaaattccctccatcatgcggagtcctaaaaacataaactcttccatctgcccttttcgtgtaatgcgctctgccgaagcatgcagattcgtggccggaagctgttccaccctgccggatgcgccgctcccctggctatccgttatctcattctcccagataccctcacgaatatgtctggtttcttccagatacacatacaattcccgcgtgttgctgtagcggatattctccatcagagacgacgcgccaagccccagtcccagataattctcccgctcccagtagccgatattgtgccggcacgcataacccggttttgcaaaattagaaacctcatagtgcacatatcccgcttccgcaagcacctgctcggtcagcttggtcatccggtacacttcatcctccgtcggcagcgccaccgtctgcattcccgcctgctgcttgaccgcgtcaaacttatacagatcgtaaaatggcgtccccttctcaatgatcagggaataggcggaaatatgctccggtttcagccacagaagctgctgcagggtgcgggcaaaactctctgccgtctgtcccggaagagaactcataatatccacattgacattgtcgaatccgtttttgcgcgccagctcgtaagtcttcaggaactggtcaaacgtgtgaatccgcccgagaatctttaattcctcatccacagccgactgcaggccgatgctgatccggttgattcccgcattccggtagccggcaaacttgtgatcggtgacggttcccggattgcactcaatggatatttccgcatccgacgccagacgaaacgaccggcgaaccgccgacataatctgtgccatccactcctctgtgagccacgatggcgtgccgccgccgatatataccgtcgataccaggtagtcgctgcaatgcggtccgtaatacgcaatctcccggagcagcgcctccacgtaggctgcctgcgttgcctcgtccgccgcaaaggaaaggaaatcacaatactggcattttttgacgcaaaacggaatatgaatgtacaattccattgttttctgactcactccacacgccgctcctttcccaaaaatattcctgacactgccatcactgacgctgcattttccgatctgttcctttaatcttcatccagcttcaagacgctcatgaatgcctcctgcggaatctctacatttccgacctgacgcatgcgcttcttgccttccttctgcttctctaaaagctttttcttacgcgaaatatcgccgccgtagcactttgcaagcacatccttgcgcagcgccttgactgtctcacgggcaatcaccttgccgccgactgccgcctggatcggaatctcaaacagatgtctcggaatctcttcctttaacttctcgcacatctttctgcccctgtcgtaagcactgtccttaaagacgatgaacgagagcgcgtccacctgctccttgttaatcagaatatccagcttcacaagctcggaacgctcatagcccttcagctcatagtcgaacgaagcgtatcctctcgagcgggactttaaggcgtcaaagaaatcgtagatgatctcattgagcggcagatcgtacttgatgagcgcacgggtctcctccagatactccataccgttgtatacaccgcgccgttcctggcaaagcgtcataatcgcgccgacatactcgctcgtcaccatgatctccgccgaaacgaccggttcctccatatactcgatctcggacggatccggcagattagacgggttcgtcagatcgatcacctctccgttcgtcttgtgcaccttatagataacgcccggtgccgtcgtcacgagatccagatgaaactctctctccagacgctcctgcacgatctccagatgaagcagtcctaagaaaccgcagcggaatccgaagcccagcgccagcgacgtctccggttcatactgcagcgacgcatcgttgatctgaagcttctccaacgcatcgcgcagatccggatatttggcactgtccgccggatacatgccgcagtataccatcggattgacttttttataacccggaagcggctcctcacacggatgtgcggcgttcgtcaccgtatcacccacgcgggtatcccgcacatttttgatgctcgcacagatgtagccgaccatgccggcagacagttcgtcacacggaatgaactgccctgctccaaagtaaccgacctcggtaacttcggactgcgccccggtcgccatcataaggatcggatcgccgacccgcaccgtgccctccttgatccggcagaacacgatgacacccttgtaggaatcatagagtgcgtcaaagatcagcgcctgaagcggcgcttttggatcgccggccggcgccggaatcttctgtacgatctgctctaacacctgatcgacattgagtcctgtctttgcggaaatgcgcggcgcatcctccgcctcgattccgatgacgtcctcgatctcctttacgacctcgtccggctgcgcgctcggcaggtcgaccttgttgatgaccggcattacatccagatcatggtctaacgcaagatacacattcgcaagggtctgtgcctccacgccctgcgccgcatccacgaccagaatcgcaccgtcgcatgccgcaaggcttctcgatacctcgtagttaaaatcgacatgtcccggggtatcgatcagattaaaaatatattcctcgccgtcgttcgccttgtagataatgcgaaccgcctgcgacttgatcgtaattccgcgctctctctccagatccatgttatctaacacctgcgcctgcatttccctgctggtcaaggttcctgttttttctataatacgatcggcaagtgtagatttaccgtgatcgatatgtgctatgatacaaaaatttctgattttactctggtcaatcgacattcatttcctcctgcccggtgcgcatcacttctgccctccggcagccacacgcatcacttatctgcaatattataagggataaaaccggaaaacgtcaagggaatcgcggttcgcaaaaaccacgcaatttatttgcaaaccgcgcatatatgagcaaaatttcacaattttacactggatttttccccagaatatgatatgatatcaacgtcgatatttatcggcatgggttttggtgaataaaccgagaaaacccccttcttaagcgaagaccccctgctacggtggctgcaaacaccataacaggggttcttcttattttatgtatcatatgataactcagatatcttttccaaagtcaagaccgctcttctcgcgcttctcttcctgcagtgcaaccagatccgccagtgtgatatgatccacgacatcgctgatcgcctggttcagccgcttccacacctccacggtaacgcaatccacttcgcgttcgcaacttccttcctcctccacgcaggcaaccggcgcgagcgatccctccgtcagacgcaaaatatcgccaaccgtgtattcctccggtgctttccgcagcgaataaccgccctgcggtcctctggtgctccgcacataacctgccttgttcaatacggatatgatctgctcaagatatttgtctgagatctgctgtctttccgcaatatctttaatgcgcacaacgttgttctcaccgttcatcgccagatccagcatcaggcgcagcgcatatctgccttttgtagaaattttcatattcgttcacactaacacctttcctgcttctgccagtccagaagatcctgcaatgtcacatgatcgaccacgtcccggatcgccttatcgactttttcccagagcatgatcgtcgcgcatttctgctgtttggggcagggattctcggcgttcgcaagacactcgaccggcgcgagcgatccctccgtcagacgcagaatatcaccgatcacatattcgtccaacggcttcgtcagacggtagccgccctgaaatccccggctgctggaaacatagcccgccttgttcagaatggaaatgatctgctctgtatatttgacggaaatctcctgtctcgttgccatctccttgaccgacaccggatgctccgtgccgttgaccgccagatcgtacagtatgtggatcgcatagcgtccctttgtcgtaattttcatgctatcgggcccctttcatcctgctggcttcaccgaacagctcttcaaaatcctcttttaagaagcggtgataaaacgcatgtccctcgtcgaacttgacgcagtacagataagaatccggattgccatcctcaaagtagcacacgtcatcaaattcatcgcttttgatctcaatgatacgagcactcttagaatagtgccggaacagctcccacacctgctctctcgtcacatcatgtctgccgaagcagtcaatcagatcctttaagaacggatgcgccacgccgtgcgcatgcacatactccgcacccgctgcaggaatgagaaaacagattctcccgccgctcgccccagatactgccacttcaccgagggtatccgccgcatatgcgccaaatccctccagcgccgcaagaaccgccggcttggagcggtcagacagctttaacacatgtccgattgacgacgatggtgaataaaaccggatcgtctcacgctcatagccgagctttagctgttcctctaagatcatgtcgcataaatattcttttaatgccgtatagtccgcttcatcctgccgattcattcttagtaatcttcctcttccagaccttcgctgatatcgttcttcggcttctcaagaccttcgatcttgatgttatgcttctctgcgtaatcccagagtgccgcatgaattgcctcctctgcgagaagagaacagtgtacctttacaggaggaagtccgtcaagcgcctccataactgccttgttcgtgatctgcagcgcctcgtaaatggtcttgccctttacaagctccgttgccatactgctggttgccacagcagcgccgcagccgaatgtcttgaacttgcagtcacggataacctggttctcatcaatatcgagatacatacgcatgatatcgccgcactttgcatttccgacggtgccgacaccgcttgcgtcctcaatctctcctacatttctcgggtgctgaaaatgatccataaccttttcactatacataacatatacctgctttcttttttatattatttgtttttcttgatgaaatcctcgtacagcggagacatctctcttaagtggttcacaatctcttttaagttgtcaacgacgtagtccgcatcctccatcgtgatctggtcgctgatggtcagacgcagagaaccgtgtgcaatctcatgcggcagtccgattgccagaagtacatgggacggatccagggaaccggatgtacatgcagaaccgcttgatgcgcagattcccttggaatccagaagaatcagcatggactctccctctacgaactggaagctgaagttcacgttgttcggcagacgcttcacacggtctccgtttaactttgcatacggaatctccttctcgatgcgctcgatcaaatgatctctgactttgatctcctccgcagtgcgctccttcatgttggccgtagcgatctctgctgcctttgcaagaccgatgataccggttacgttctcggtacctgctcttctgtggcgctcctgtgctccgccgtggataaaggatttgatcttcacaccttttctgatatataagaaaccgattcccttcggtccgttgatcttgtgaccgctggtgctcatcatatcgatattcattgcctcgacatcgatcggcacctgtgtgtatgcctgtactgcatctgtgtggaacagtacgccatgctcatgtgcgatcttaccgatctcagcaatcggctcgatggttccgatctcgttgttcgcgaacatcacggagattaagatggtgtccggacggatggctgcggtaagctcgtccagctttaccagaccgttctcatccacatccaggtaagtgatctcgaagcctttcgtctccagatactcacaggtgtgaagaatcgcatgatgctcgatcttcgtcgtgatgatgtgctttcctttggacgcataggcatctgccgttgcctttaatgcccagttgtcagactcggaaccacctgcggtaaaatagatattctccggcgtggtgttgatggtcttcgcaatgacctctctggcatccgtgattgctttcttattctcagaagaaatgctgtatatgctggatggattaccgaacttctctgtaaagtacggaagcattgcatcaagcacttccggtttgaccggtgtggtagctgcgttatccatgtaaataagtttcttttccatattctcgtaccatttccttttttatttcatatcatacccatatgatatgatttatactagtatcattttttttatttgtcaactgcaaaatacctgcgggagatattgtacttcattatatacaaaaagaggacgttgcacagccgccccgacggtgtaacatcctctctttatgcatctttcctgcagtttctccgaaaaaatccagttttctcttcaccgcatacgattccttaaattaccttccgtatccccgtaggacttcacaggtctgtgcgatatcctccgccgtatgtgccgcagagacaaacattgcctcgaactgcgacggtgccagatatatctgatgatccagcatataattaaagtaatccgcatatctggaaatatcggaggacgttgcagtctcataatcctttactttctgggcagtaaagaaaatgctcatcagcgatccgatctgattcacgcagacgctttcgccaaaatgtcctcgcatgccctccgcaagcgtcctcgcacttgcttcgatctgtgtgtagatttccggcgtctcttttaagatggtaagcgtctctatgcctgccgtcgttgcgatcgggttgccggaaagcgttcccgcctggtataccggtccgaccggcgcaaccatatccatgatctcttttctgccgccgtatgcgccgaccggcatcccgccgccgatgatcttgccgagcgtcgtcagatccggcgtcacatgaaaatatccctgcgccccgccgattccaagacgaaaaccggtgattacctcatcaaaaatcagcagtgccccgtaatcttctgtgatttttcgcagaaattccagaaatcccggctccggcaaaacgactcccatattggcagccaccggctccacgatgatcgcagcgatctcttttccctgcgtctcaaagagcttctgcaccgaatccggctggttgtactccgccaccagcgtatttttcgtataatccgccggcacgcccttgctgtccggtacagactgtgtgagcgctcccgatccggcttttaccagaagtccgtccgaatgtccgtgatagcatcctctgaacttcacgaccttatcccgtcccgtaaatcctctcgccacacggatggcgctcatcgtcgcctccgttccggaacttaccagtctggacacttccatcgacgggatacaggaacggatcagctctgcaagctttagttcctttcctgtcggcgccccgtatgtcagcccgttctcgcacgccgcctgcacggcttttattacgcgcagataggcatgtcccagaatgcacggtccccaagaacacacatagtcaatatacgcgttgccgtccacatcatagatgtgggaaccgctcgcccgctccacaaagaccggcgtccggtgaaccgcctgataggcgcgcaccggactgttgacgccgcccggaatacatttttttgatgcctcaaataatcgttctgattctgtatactgcatatttctcctcatttccggcactgctgccattctcttccactactttctctcctcgtccagccactttgccacatccagcgcgtgataggtgatgatgattttcgcacccgcgcgtttgatgccggtcatgatctccatcacgatccgccgctcatcaatccagccgtttgccgctgccgcctttaccatcgcatactccccgctcacattgtacgccgccagcgggtaatccgtacggtccatgacctctcttacgacatccagatacgcaagcgcaggctttaccataatgatgtctgcgccctcctcaatatcggacagacattcccggatggcttccctgcggtttgccggatccatctggtaagttctgcggtcgccaaagctcggcacggaatgtgccgcctcgcggaacggtccgtaaaaaccggatgcaaactttgcgctgtacgccatcagcatggtatttttgcagtcgttctcatccagagcctcacggatcgccgccactcttccgtccatcatatcggatggagcaatcacgtccgcgcctgcctttacgagacttaccgacatttttgccaaaagcggcagtgtctcatcatttaaaatctcaccctcacacacaaggccacagtgtccgtgggacgtgtactcgcacagacacacatccgcgatcacgagaagctccggcatccgtttcttgatgtggcggatcgctcgctgcgtcacgccctcatcatttgtgaactacctcttcgcgtgctatgcgattccgcttgtgattttcgctacgcggctctggatggctgcgttgaaaaacagaatcacaaatgcagtaaacagcatcaccagtgcgatggacgttgcccccgcgtaatcaaattcctgcagcttcgacataatcattaacggcgcgatctccgtctcatacggcgtgttgcccgcaatgaacaccacgcttccgtattcgccgagccctctcgcaaaggacatcgtaaatcccgccagaagcaccggggcaatctcgggtaaaatcacccggaacacggtctgtctcgtattggctccgagcatgtgtgccgcctcctcatactggagatcgatcttctcaagcaccggctgtaccgaccgcaccacaaacggaatcccgatgaaaatcagcgccacagtaattcccagttttgtgtaggcgatctcaattccaaacttattgtaaaaaaaggcgcccaccaatccgttggttgttgtcagatgcgtcagcgcaatgcccgccaccgcggtcggaagcgcaaacggaagttctatgattccgttcatgatccgcttccccgaaaattcgtaccgcaccagctcccaggccaaaatcacgcccatgacggcgtccaccagcgccgcgaaaaatgcggtctaaaaactaaccagatagctggataccacacgccggttcgtgatcgtcgccacaaactcaggaaaagacatctgcgccgagaagataatcagtgaacagagcggaatcacgacaatcagtcccagcatcgttatggtgattccaaaggacagtccgactcccggaatcacacgttctgttttctgttttttccctctcatgcgacactcctcctattttcttacttttcctatctattttatatgaaatatactttactcctacttatccacactgtaaagtatgtttttgtaatttttagtaataaagtggtaaagtgacatatgatacagaggaattgccgcgataagcatagatcttgtttgggtgaataagtaatattatcagaaatagatacttaaaagttccagataaccatgcggcggtgaattttgcttcaaagaatttgccgccgtctgtttattctggaacttttttgttctctggtcttctgataatattacttattacccaaatgaggtctgtacttattgcaacaattccagctgtatttcaatgtgactaatccagcacggtcttccagccgctgctctcatatgccgcaaagcacatcccgatctgttccgccgtcactttttcttccgcaagcggagacggaagggcgtcctttgcaaaatacgcggtctccgtcgtctcaatgttttcctggaagcttccgccggtgacgctgcactgcacaaatatttttatcacgccgtagggcagattgtagcggttatgctttctccagtcgtgaaccgcgatcactttctccggcttcacgagaagacctgcttcctcatgggtctcttttaccgtgttggacgccaccgactgatccacgtcgcaccagccgcccggcagcgaccatgtcccgtttttttcatgcaccatcagtatttttccatcgacaaagacagccgcccgggtgtcaatcttgggcgtctggtatcctgtttcattgcagaaaaaccgttttaccgtatccaccggcacttccgtccccacacacagcatctctgccgctatgttccgcagctcctcgtagcgctccttgtcatattcggttccaccgtaggtaagtcccgcctgcgcaatgctctgcacgcgcatcgcaagctccatccactgatccatgcttcctccattccgcagacgccgtgcgtcgtgcatccgtgttatctctcctgtatttcctttccgctgagatgctcgatcgtaatctcgtatacgctcaccgcttttcccacgcgctccatctcctcctcgatcatcgcctcatccggataatattttgccgcctctgtgctgatttcttttgtctttcttctgattggttgaaacatgattgcctcctttttcccgtctctcttctaaaatgtcaatgtctgccggatgctgtatccatccttcttaaaatccgaaaacagcgcttcgatctttattatttttctcaagaccgatgaatttttcaccgccctcccacagataatcgataccattttttcatgtaggcatcctttaataattcgttatccgcattcactaatttcacaaacagacctgtcagtccatcatatttgtggaaatcgcctgcatcatataatatcacaaaatcattttgccacagaactttccgtttcacaattcgtatttggcaatcccacgcactttttccgatcttacaaccaaatagtaattttatattttatattgtatatacacgcaaaaacagacatgataccgattgcttatcggaacaccatgtctgcttttgaaaaacttccatccttctggaagccctttttatcttttctgaattttttccttaattctcggacttacaatctgaatcataattaccacaataaggataatgcctttgattgcgtcattgatgagagaatccatctttaacgccactataattttatcaatgactgtgtaggacatcgcaccaaagagaataccaagcatttttcctctgccgcctgacatgctgattccgccgagaaccactgccgcaatcgcatacatctcatagctgcttccggttgttgccgggtctgccgacgcattcatcgcaatccatacaaacgatgccagtccgacaagcgctcctgcaattacaaaaacagaaacctttaccttatcaacgtcaattcctgtcatgcgcgctgccttcgcattgcttccaaccgcatagatctgttttccgtattttgtttccgttgtcagatacacaaaaataattgtcactgcaatgaggaggattcccacgattggaaccgtaagcacttttccgtttcccatattatacattgcctgatacagcgtattcgcattcgccatgcggtaaacagaacttccgccgccgataaggttcttatcgatatgctggcaataatactgtgcaaatgagcggtaaataagcattgtcgcaagtgttgcaataaatgccggaatttttccatatccgaccagcataccgttgatcagaccgcacactgcgccaaaccctaccgcaaaaaggaacgtcaataggatgttatctgtcatgttaaatatcactaccgaaaaaccgcttacaagcgcaagcatggaacctacagaaaggtcgatatctccggtcaaacagatcagtcccatgccgaatccaatgattccaatgactgcagaatgccggaatatattcataaatccactcatcgtcaaaccgtgattggtaatcacatatacgattaaaatgataacataaacagcaatgtagctgtattcactcaggaatttcgttcgttttgatttctccttcattataaaacctcctctaactgtacagcatttgttgcataactcatcactgttgtttcatctatctggctatgcgcaagacttcctgcaattttcccgttataaaatacgatacagcggtctgcaactttttttatttccggtatctcaagtgtgttaagcagtatggtttttccttcggaagcaagcttcagaatcaaccggtagatttccgcttttgctccgatgtcaattccctgtgtaggattatccagaagcaggatatccgcatctgtgtcaagccatcttgccagaaataccttctgctggttgccaccgcttagcgacgtaataaaatccgcactatcggctgcttttatatttaatatatctttaaaattctgatattttttctcttcctgttttttagaaatacaaggtttctttttggaaagaacatgttccgccaggtacatattctccaaaatcgacatatcaggaacaaccgaattttctttcctgtttgccggaagcattgcaaccttgttcttcattgccgcctgaatcgaatgatgaggcacacaatttccatttacatacatatttccgccatatgcaggtgttgcaccgaacatgcactgaagaagttcactgctgcccgctccctgcagtcccgtcagcccgataatctctccctttttaacttcaaaactgacgtcacaaaatccttctccgctcagattctcaagttttaaaacagcttcgcctttttgtctcggttcataaatctcgccggaagaataattttctcccaccatcttctgtatgatggtatctgtatccgcctcgctgatttttccggaatcaataaattccccgttacggaaaatcgtatagctgtctgaaattctgaaaatttccggcattttatgagatataaagataaacgctgtcccgctttccttcagtcgctctataatatggaaaagatgttcgatctcactgttgttcaaagctgtcgtcggctcatcaagaatcagcaactttgccttaaaaaacaatgccttcgatatctccagaagctgcttctggcttgtcgtaagcccggacacctctatttccggatcaatttccacacccagttcctcgaaaagttccctcgactcttttatcattctctttgtatcgactttcccgaatttattggtatattctctgcaaagaaaaatattttcataaacctttaaatcattaaacaggttcaactcctgatgtacaaacgcaatccctgcgttttccgaagattttacggatatatttttcatttcttttccgtcaaacacaactgttccggcgtctttgtcatgtacacctgtgagaatattcataagcgtagattttccagctccattctctcccaaaagtgcatgaacctctcccgcttccacccgcagagaaacttctttcagcacctgtatgccattaaaggatttgcatattccgttcatctctaataaactcataaataactccattctaccgaaatgatcatcttttatcatgcatgttgtccaccatatcgggcagacaacatgcattggtttaccaaattagaatccttcgtactctgtcacattctcagatgtcacattttcacattcaatcacatgatcctgcggtaccgtttttccatcaagataatctaccatatcctgaattgctgtctgaatcatcgacggactatatgtaacagataccagacctccaaactgggctgtaagttctgtataattttcgccgcgaagcattccgtaaaattcatccagtccgccacaaccactgattaccggctgatttgcaagaaatgcctctttggttgtctcatcgattccaccgccgttgagcgcctcgataatacccattgcaagctcatcatcttccgcatagaaccactttgtatcagcgtttccagcatcactcatcaatgactcaaatgcggtcttggtatctgatctgctccagttcattgctcctgaatatgtgattgcactttccacctgctcttctgtccactttaaggaatcctcaatcgtagcgtcctcgaactctgcatttccaagcagatattctttaaatccctggtcacggagtgttgttaccgaagaggtatcgccctcatatacatatacctcatcccccggctgcattccgcaggatacgaaatatgctgccgcggcgacaccgattccttcattgtcgccttttacattcgatacagcgctcgatgcaacaccatcaatgatccggtcaaatgctacatatggtatttctgcatccacgatctgctggatcgccgactgcactgtgtcatcaattggctgaataacaatcgcgatatttttctcaccttttgagaggatatcctcaatatttctaatctgctctgaagcatccgctgaagtaatcagctcgcttgtgtatgttcctgctgcatttacttcctcgattttctcctttgcaaatgttgcaacagaacctgtccagccatggtcctccggtgctgtcaaaacatagatatgcgtgctatccccgttttcgctttctccggtgttctgtttttctgtagctgcctgtgatgtcgacgcgctttccgtcgcagcatctgatcctccgcatgctgttcctcccaataccattgctgttgtcattgccaatgccaaaattctctttctcatagttttttccttctttcttttatttattgaaacggtacttaccgtccaattacattggaaactgtctgatatactcttttgattttaaaagactctttaaaatctcttctctggagctctcaaacgctttgtcttctacctcaatacatacgtatccgtcatagccaatgtccgtaagcgcactcacaaactttccccaatttacatcccccaatcctgggagcttaggcgacataaacttcagtggataagccataacccctacctttgccagtttctccggatataactttatatccttaaaatgtacatgaaaaatcttatccttatattcatagatgggatggatgtagtccatcatctgccatacaaaatgcgacgggtcaaaattgattcccagatattcgctgtcaaggatctcaaaaatcttatcccagttctccggtgatgtcataagattctgtcccccaggccactggtcctcgccaaagagcatcggacagttttcaatggcgatcttcacctttcgttctttcgcatactccagaataggcggccagattttctctaccagctttaaattctcttccacgctttttgtctgatcccgcccgataaaagtcgtaaccatattgacgttcagcttcgcgctggcatcgatcacgctcttcagatgtcgaatattctcttcgcgtttttgttcgtccggatccatcgtgttcggataaaaagcaagagaagatatctctatttttcgctctttacagtagtttaagatgtactccgccttctgatcatcaagcgtctctgtatcaatatggcacacccccgcataccttctctctgtcttccctgcactaggccagcatgcgatctcgacacattcaaatccctgtgccgcagccgtatcgatcatttcttcaaaagaccatccatccagtatcgaacttacaaatccaagtttcatccgtgtatcctcctattgaatcatgattgtttttttctcttttgcagattccaggcttgcgaatattgctttcattgcattcagcacatcccttccgctcacttcaggttcatgattatttaccactgcttccacaaaagaatcaatgattccggacttcgtctgattatcgttggtttgaattttgtctatgtcgtatagaattttctcaccgccgcgtgtgatgactttaatagagtaaaccggatcatcatatattttcataattccttctgttccgtaaagaattgttgaattatcctcttccccgtaataagtccagcttgccgtcatggttccaaccactccgttctccatcttatagatgcagattgcattgtcatccacaccgatcagatttccctgcgcgtccttcttgtcaagcgttgttatatgcgctgttgtttcaatgactctcgaatcaagcagaaactgtatcagatccgtcttatgaaccccaaggtctgccattgctcccataacggaacgcgatttgtcaaaaaaccatgtgttcttcgcaccgtcaattccccatgtctccggaccgccatgtccgaatgtcgtcttaaaagtaattacgtctccgattactccctcagagattaactctttcgcctttacatgtgcttttgcaaatctctggttctgccctatcatcagatatttcccgttttcatccgcagcttttaccatgtccatgcattcctccagcgttactgccatcggtttctcacaaaggacatgctttccagcattcaacgccttgatcgtaacttttgcatgtgcgttatttgccacacagacactgacagcatccatctccttgtctgccagaagttcatcctccgtgctatatgccttgccgccaaattgcgctgccagttctgctgcccggtcagcattccagtcataatatccaacaatttctacatccggattttccaggtattccggaatatgtctaacctgtgcaatttttccacacccgattattccaaccttcatgttatctcctttcatattttctttcattctttcattctcttgaaacaaaagtaacatatttttttcagcaattcaatcattctatcgtcatttcaagcattttcagcgctttgtttctttattttcgtttattttgtcaataatcgccaaagtatttcttatatagctgaaaacttttcacattttgtttcattttatatttacaaaataaacaaaactggtgtatcattattatattgatacacaggaggctcacagagatatgaaaaaagataaaattacggtcgcagacatcgcaaaaaaagcaggggtctcccctgccactgtttcccgagtgttgcgtcatagagaacttgtaaaatccgaaaccatccagcaagtcgaaaatgccatgtccgcactgggatgtcttctcgaaaagggtactatagctgcggctaccgaacagcctcttattattttgaatgttccggaactcgataacgttttctacctgaaagtcatcgacggcgcccttgtatccgccaaggcacacggttatcgtctgctgatcaacgactccccgcttgaccggagttctatttactcttttatcaatctgttaaaacaggtacatgccgccggagtcattttattgaatcatgtctccaaggaacagctggatatgatccactctgtcgtaccgttagttcaatgcagcgaatataacgagcacgcggattacccttatgtcagcatagacgactatagtgccgcaacaagcgctgcagaatatattgtttcctgtaattgtaataaaatcgcaatgataaacggtcccatgtcctttaaatatgctgtgaagcgtcaggaaggttttcttgatacgctccgcaaaaaagatatttccgttcgtccggactggattgtcagcctgcctgaagtaaattaccagatggcatactccgcagtctgccgtctgttgaataatgaaattcgtccaaatgcttttttcgttatctcagacgtttttgccgccgctgtcattcgtgccgctaaacgctttgatcttcgtattccggaggatattattgtcgtcggatttgataacctggacatctccatcatgacctgtccgacgattaccactgtaaaccagccgagttttcagctgggctattcggcatgcgaacttcttcttgattccatcaaccatcctgatatgtttcccaaatctctgattctggatacagaacttatcatccgggaatccagcgcaaaaatttaacgcccggcagattgctctgccgggcgttccctgtaaatttcctaatcactgttcatgaattgcttcaaacactccgccgtccgcgaaatgcttcgccgacgcctcactccatccaccaaagtgcgcaatatccgtgagtgcaatgtcatccacgatccattttccgtctgccggcagttccgtgatgacgcgctcccccgatgtactgatataatcggaaaaaacatccggatccgacgggcggtagaagttctccgcaaacgtggtcgtcgcaccgcgcgcacccgaatccagcaccagcacattgtgatagagtgtcttcatattctctgtgatctcttccccgctctgtccctgactttcaaaatagtaccatgccgccagataattccagcgcgctccgccggacgtcttcgggttcggggtgatgacgcccacgtcctcccggagcagatcatcccagtccgcaatgttcttcggattgtccttgcgcaccagaaaaacaatcgtcgatgtgtacggggaactttcctgatcaaattcatcctcaaaaccatcctcaatcattcccgcatccgcaaccacctgcacatccccctccagtgccagcgtcaccacatccgcctccaggccgtttgccacctcaagtgcctgcttgccggaacctccgtgcgactggatcaccgtcacatcctgccctgcctgctccttccagtgttccgcaaacagtgcattgtacgattcatacagttccctgtgctttgaaccttccgttacatggtcagttcttactttgtctcgccgccctctaccacaagcgtatcctcgtagtcactgccgtaagtgtcagccagtgttgcctcgtaatctgcgtggaaaaaattctcctcgccgagtgccttgatctcctcattgatccagtctaatacggtcgtgttgcccttgctgactgccggcgcaattgtatctgtgcttccaagctccggtatacctacggtatagcccgggttctggagtgcaaatgcaatgacctctgtgttgtcatttgcccatgcaacaccgcttccgttctcaagcgctgtctttgctgccgcataggaatcatatttctgtaaggtcagatccggatagttctcggtcaggtaggtctctgctgttgtaccggaaatcacgatcaccggatcatccgctgtcagatcatccagactctcaaccactgcagaatccggagaaatcacaccgagggatacgttcatgtacgggagtgcaaaatcaacttcctccgcgcgctccggtgtcacggtaaagttagccagaatgacatcgacttttccggtctgtaaatactcaatacggcttgcagcctcggtggaaacgaagttcacatccacgccgagatcctctgccagacggtttgcaaagtagacatcatatccctgatactctccgttctcatccacatagccaaatggattcttgtcggaaaatacaccgatgttgattgtgccgctctccttgatctcgtctaaggtgcggtataccacatctgcggatgcatcgcctgcggatgcctgtgtatctgcggtaactcctgtctgcgcatcactgctgctctccgctgcatctgtattgccacagcctgccagcattgctccagttaatgtcagtgctgtaaacagtgccagtctcttcgttaatctttcttttttcataatattgtcctctctttctattccaaacttccatcgaagcttcagaatcaaccttttgtgccgctctctagtcgcggactgcctcaaattcaaatgtgtgcagaaactttttcgcacgctctgtcgtcggatgggtaaaaaattcatccggctttccttcttccacaatctctccctggtcaataaagaccacacggtctgcaaccgcccttgcaaaggacatctcgtgtgtgacgatcaccatagtgcttcctgccttagcaagctctaacatcgtatccagtacctcgcgcaccatctccggatcaagcgctgcggtcacctcatcgaacagcataatctcggggtgcatcatcagtgcacgcacgatcgcaacacgctgcttctgaccgccggaaagctgtctcggaaaactgtcacacttgtcgagaagccctactttttccagaagctgttttgcctcggaaacggcgtcctcttttgttctcttctgcaccttaagcggtgccaggatcacattttccaggatcgtcttgtgtggaaaaagctcgtagctctgaaataccatcccgaccttctgacggatcccggcgatattcttcgcctttccgtcgatggtctcgcctcgaagcgtaatgcttccctcctgaatcggctctaaggcgttgatacatcgaagcagtgtgctcttaccgcatccggatggtccgatgataaccacaacctctcctttgtggatggtcaggcttagatcctttaagatcttgtttccctcgtaggattttttgatatgttcaatttttaacaattcttctgcttctgccttcatatcagttactccatttcttttccagatgtcccgccagcatactgatcggccagcatgccaggaaatacagtacaaacacggttccgtacagtccgaacgccgcattcggcgatgccatacggtttgcctcgatgatctgctgtgtcacctttaacacctccaccacaccgatcatcatcacaaggcttgtcgtcttaatcatacgggtgaccaggttgatcgacagcgggatcagacgccgcagggtctgcgggataataatgtaaaaataaatctgacttctcgtcattccaagcgctgcaccactctcatactggtgcttcgggatactgattaacgcgccgcgcaccagatctcccatctctgcggttccccagaatgtaaatacgattaccgatgcaaactccgccgataaattccagccaaacatccgcgtcgttccgaaaaacacgagaaacagcagtaccatctgcggcatgatgcggacaatctccagatacactcttgtcactgcttttgtcaccggattcttccatgtcatgacgatgccgagcagaatgccgagcggaatactgatgaccacggcgatcaggctgatcttaagcgccacccacagaccgcccagaagccttatcatgttcttgcccttaaacaggacgctaattcccaaatccggcatagcgcagcctcctctctaacaatgttccaaggatggataccggaagtaaaataatcagataaaataccaccagtaagaacaggcactccgctgtcttatagtaaagtccgatcaggtctttggctgtaaacatcagatccatcaggctgattgctgaaaacacactcgtctcttttaacaggaagatcacattcgccacaaatgccggtacgctgatggataccgcctgcggcagaatgacatagaccactgcctgcttcttcgtcatgccaaggcttaacgcgctctccatctggatcggctcgatcgcctcgagtccgctgcggaacgcctccgccatatagctgcctcctaagagtgccagacccgccacgccgcagacatccgcggagatggaaagtcccaccttcggcagtccgaaatagataaaaaagagctgcaccagaagcggtgtgttgcggaacaattcgatatatatttttacaatctgtctcgccaccggtatcttataatgtacaatcagcgcacatataagaccaatgatgattgaaaatgcaattcccatccagccgatccggagtgtcagccacatggctttctgatacagcggcaggtattgcgagatgacttcccagttcacattttcacatcctatcttatttcttattattcctagctgttttatatgatataagaaatatactcctactttatatatatgtcaagtaggaaattaaataatttctttttgttctaaaaaagaaacagaatcattctgtgtcagagaatccttctgttttgttctgttactctatttctatattctatgcagttttaatattatgctttccggatgccgtcgttcatgcttcccatccggtatccgccgagatcgagtgtcacataggtaaaaccgatctccttgcatgccgcattgaccttctggtaaaaatcgtctgcaaacatttttgcaaaatcctccgtgccgatctcgatacgggcaatcgtgttcgttccgctctcgtgaatccgcacgcgcacctgatgaaatccggcatccagcagaagctgctccgcgcggtccaccatgccaaggcgctcctcggtgatctcctccccgtagacaaagcgggaagaaagacatgcaaacgactgcttattccatgtcggaagccccagcccgtgggagagttcgcggatcatgctcttgttcatccccgcctcgcgcagcggactaagcacggaaagctcggcaaccgccatcagtcccgggcggtaatcgccgttgtcgtccagattggacgcctccgccacgtaggggatgtcgtactcctttgcaatatcccagatctttgtgaaaagctccttcttgcagaggtagcagcggttggtcggattatgggaaaatccctcaatctgcaattcctccgactccaccacgatatgttttatgtgctccttctcacagaatgcttttgcctctcttaattctctctccggaaaggaacaggagcgagccgtcactgcgaccgccccatctcccagcacgtcatgtgccacttttaataagaatgtcgaatccacaccgccggaaaatgcaacaaccatcttccctttttcccggatcgactgttttaatgcttccatttgttccatcgtattctaaacccgctttcttccattttaattacacaaacggattgtaaaaacggcttccgttgctgaaggtaatcatcagtgccaccgcggaaaatgccgccgtcacaatcagcaccgcatagtctgccgccgccagcggctttcccatataccaggtgcgcttcttgtgctttccgaacccacggagctccatcgcattgctgaccacgtcgatgcggtccatgctggagaataccagcgggaaaatgatcgccgccacgttcttgatgcggtcgccgagcttcgccttgccagacatctcaattcccctcgcctcctgggcgtgcttgatttttgcaaaatcatcctgcacatccggaatataccggagcgcaatcgccacggagtaaccgatcttgtagctgacaccaacacggtttaaagaagcggccagttcgctcggattcgttgccacgataaacatgaacaccgctggaatgaccgtcaggtattttaccatcacgttgaactcataaaacagctgctcttttgtcaacgtgtaatgtccaaacagatgcactatcggcgtctccgttccgtaaatcttcgtcccctgtcccggagaaaagaagaaaatggcgatgagattgatcaccagaaaaaacatgatgaacttgaataccgtaccgacctgcttccacttcgtcttcgacatggcaaaataatcaggctgcacacaagcatgaccaagagcacccgcgtatcgtaggagatcatgctggtgatcgaccacaggaggaaaaacaaaagctttgtcaccccgctcagacggtgaatccatgtgtctttttcttcatatgataatacgcgcgacattatgcttcctcctctctttctgccgctctcatctgccgctcgtagccgataaagcgctccacgaactgtgtcggctctgcaatgccgcagcgcaccgccagatcgtagagagatgttttcttcaaataggcacgatccgccaccgcatcatccgtgagtaccgccgccggagcggtatctgccagaagcctgccgtcagcaatcacgaccgcgcggttcgtatactctaacatgagatgcatgtcatgtgtgatcatgatgatcgtaatgccgtactcctcattcagcttctttaaaaactccatgatctccgtataatgtctgtagtcctgtcccgccgtcggctcgtccaaaatcagcacctgcggatgcagcacgaggatcgaagcgatcgtcacgcgcttcttctgaccgaagcttaacgcggagaccggccagttgcggaactggtagaggccgcagatctttaaggttgcatagacccgctccttaatctcctcctcgggcacgccgcgcaccgcaagtcccagcgccacctcatcatagatcatcggtttgctgatcatctgattcggattctgcatgacaagtccgatcttctcgccgcgctccttgatcgaccagtctgcaatgtcctcgccgccaaacagaatccgcccctgaccgggctttaaaaagccgcagatgagattcgagagcgtcgactttccggcaccgttcttgccaacaatcgccagcatctcgcccttttgtacctgcatatggatgtcggttagaatcggcgttcttccgtcataggaaaaagcaagattctccaccgagaggatgacgtcatcccccggttttttctccggcagtgcaaccttctcgttccagcggcacagcgcctccttataaccggacaattccatcgtctccacatgcgccggatgcgtctcgggacggatctcgcatcccgcatgcttaagcgccgtgatgtagagtggctcgcggattccctcctccgccagtacattggctgccagaagttcatccggcgtcgtatccgccacgatctttccctcaccgacgacgatgatgcggtccacatcccggtacagtgcatcttccagacgatgctcaataatcaggatcgttgccccttttgccttctgcagctcatcgatcaaagcgatcgtgcgctttcccgtcgccgggtccagattggcaagcggctcgtcaaacaacaggatatccacatcacagaccagcacgcccgccatggatacgcgctgcttctgtccaccagacaatgctcctggtgcatgatcgagcaggtcttttacatccacagcgtccgccgctttgtccacgcgcccgcgcatctcgtgatattccactctgtcattctccagcgcaaatgcgatatcctccgccaccgtaagcccgatgaactgaccgtccgtgtcctgcaaaaccgtacccacagacttcgacagtccaaaaataccaagctttgcgggatcctcgcccttaatgcggtaagtccccgtgatgtctccggcataggaaaacggcacaagcccgttgatgcagtgcgctaatgtcgactttccggaaccggacggtccgacgatcagtaccttctcccccggataaattgcgagattgatgtcctttagcgtcggttccttctgggaacgatatttaaaagaaaaattctgaaattctatgatcggttccattccgaaatcctcgtcttcctctcttgtggtacttcccgactattatacttgataataattccaaatggaagaaaaagtgcgcggaaccggtcacattttgcaccccgtctccgcgcactctgtctgcttctgtctttctgctgccggaatccgcctagtcctccttggagagactggacgattttgctccgatcttggagtatcctgctgcgatcaaagtaccaagaataccaataataatcacgtttccaaggcatgcccatgcaccctgtgcaaataccttgttggcaggctctgcgtagatcacaatgtcaagtaccggcgcaacgatcacccatgcagcgaggttggcaacaacctgcacaacgttgaacagcacgatctgtttcctctcgaatccgccgtccttgatcgcatattttgcagcgaaaagtccgaccagaatgccgaataccgcgtccggaaatacccagctccaccatacgcttccataaaacagcgcatcaccgattgcatgtcccagaagaccgacaataccgccgactaccggaccgaatacggctgcaaggaatgcgagcaatgccgctctcggctgtaaggcggtgttcgggataattcccagagggatctgtacctctgtcagcgcaacgaacaacgctgttccaataccggttgcaacaacttccttaataccaaacttcattttcataacaaagtcctcctctcatttgtatctgcactgtagtataacacacacttttccgatttaccagatagaatttattcctgccatgtgtttctaccagagcttcagcacgccgattgccgtcttcatgaacttgtacttcaccgtctcgagttctcccgccgccgcttttaactccctgcggatctcaatatgctgcggacagtgctgctcgcatttgccgcagcccacacactgcgaggcgctcgccggattcttgcggaatgccgtacactgcaggtaatccctgcggccggacttttttccttcggagtacatcgcattgtagcagcggaatgtcccggggatatccaccccgcgtgggcacggcatacagtaaccgcagccggtgcatcccaccttgacgtgctttgtgatctcctgccgcaccgcttccaccagcgcgcgatctgactccgtcatgcacccgacgccgtattccgaagctgtgcgcacattctgttcgaccatctccatggaattcatgccggaaagcacgcaggtcacctccggctggtcgtacagccacttgagtgccaattctgccggggtgcggtgctcctcatcctgtgcgaacagctccttcgccgactccggcagcagattgaccagcctgccgccgcgcagcggctccataataatcactggaatccccctcgcgtgcgcgtagcgcagcccctccacgcccgcctgcgaatgttcgtccatataattatactggatctggcagaaatcccagtcataggcgtcgatcagctgcatgaacatatccgatctgccgtgataggaaaatccgatgttgcggatctctccggacgcctttttctcccggatccagtcctccatgccaagcttttttaacttttcccaggtgggaagatccgtcagcatatgcatcagatagtaatcaatataatctgtctgtaagcggcgcagctcctcctcgaacatcttctgggcgccctccaccgacttgatcaggtagtgcggcagcttggttgccaggtagatgcgttccctgcaatgattgcgcgcgaggatctccccgaccgccgcctcatttccggcatagacatatgcggtatcgagatagttcacaccggcatctatcgccgccatgacctccttttccgccttatcgatatcggcatgcccgccctccttggtaaaacgcatacacccgtagccgagcaccgaaatctcatttccgtttttatccttgcgatactgcatgatcatccgatctcctccaactgctgcagccagacagccgcgcacgcgtccgacggcatccgcagatccccgcgcggagagaccgccacactaccgactttcggtccgtccggcagacaggaacgcttgaattgctgtgcaaaaaagcgccggtaaaaggttttcagccattttaagatcgtctcatcgtcgtagacgccgtcaaacgccacttttgcgagacggtacacctttttcggtgcaaatccaagacgcagcatgtggtacaggtaaaaatcatgaagctcgtacggtcccacaagatcttccgtcttctgcgagatctttccgtcctccggcggcagaagctccggagataccggcgtgtccagcacatccgtcaataccgcgccaagcttctcatccccgcaggtatccgcgtagtagcgcaccaggtggcgcaccagcgtcttcggaacggaggcattgaccgcatacatggacatatggtcgccgttatatgtcgcccagccgagtgcaagctccgagagatcgccggttccgatgaccatgccgccctctttgttggcaatgtccatcagaatctgcgtccgctctcttgcctggccgttctcataggtcacatcatgaacggccggatcctgcccgatatcacggaaatgcacattcaccgcttccttgatgtcgacttccgtaaagtccgcgccgaggcaccggatcagggacaccgcgttgtcataggtccggtccgtcgtcccgaagcccggcatcgtgactgccttgatccggtcgtgcggcatgccgagcagatcgaacgcgcgcacggtgacaagcagcgccagtgtggaatccagaccgcccgaaatgcccacaaccgccgtcttacagtgcgtatgctccagacgcttttttaatcccgctgcctgaatggcaaggatctcatcacagcgtctgatacggtccgcctcgtttcccggcacaaacggcatcgggtcgatgaagcgggtcagagccgtctcctccgtttcaagagaaaaacgcacctccacatagctgtcatccgccatctcaaacgtcgtcatccggcggcgctccgcctcgatccgcttgacatcgatctccgtgcagatcacaccgcttccgaaccgctccgattcctttagaatatgaccgttctcggcaatcacattgtgtccggagtagacgacgtcctgcgtggactccccgtctcccgcactcgcatagatatagccgcacagaagtctcgccgactgtccgtttaccagctcccgccggtagatgtcctttccggtggtctcatctgatgcagacagattcacaagcagcgtcgcaccatttctggcatgacggatactcggcggctccggcgtccacaaatcctcgcagagctccgcgccgatctttaattccggcagagacgtacacacaaataaaagcctcgtccccatcggcacgcactctccctcgaaatcgacctcgaccggatctgccattcctctggcaaaatgtcttgcctcgtaaaattcattgtagttcggaagataggttttgggcacaaacccgagcacttccccgcggcagagcaccgctgccacattataaagttttccgttgtacgcaagcggtagaccgacaaaaaggatggcgtccacctctgctgtctcctccgcgatcgttccgagcgcccgcttcgcctgctctaaaagatattcctgcaaaaacagatcactgcaggtatatcccgtgatgacaagctccggcagcacgatcaccttcgcgcctgccgccgccgcttcccggattccttccacgatcacgccggcgttgtattttgtgtccgccacacggatcttcggtgtgacggcggcaacttttacaaatccatctctcattttctcatttcctttaactcgtcgatgtcaaaatggtacgctttgttacagaactggcattttacctcaatcgactctccgtcgcttacgatgtcgtccagatcctttctgctcagtgtcgcaatcgcacgggagacgcgctccttggagcagtcgcactggaatgcggcatccaccgtatcgttgatctcaagcccgaactcgccgagaatcagctccaagatctcctccggtgtcttcccatcttccagcatctccgtgacggaggcaatctccgtgatcttcttctcgagacgatccaccacgtcgtccggtgtaaacggcatcagctggatgataaatcctcccgcctgtctgaccgaccggtccggattcacgagaacaccgagtcctaccgcggacggcacctgctcggaggtggcaaaatagtacgtcagatcctccgcaatctcaccggtctgcagcgcgatctgtcccacgtacggctcctttaatcccatgtccttgatgacgctcatcacgccaagccccagcgcaccgccgacgtccagctttccctgtgcatttaacggcagttccacatccggaacattcgggaatcccttgacatgtccgtttgcatccgcggtcaccgtaaagcccttcgccgggccgccgcactggatctgtatcgtcagaagatccttctcccccttcatcatcgttcccatcatcgccgcaccggagagaagtctgccgagcgctgccgtaatcaccgggctggtgtcatgatccactctcgcctcctccaccagatggcgtgatgtgatcgcaaatgcgcggatacttccctccgctgcggtagctcttacaatataatctctatcctgactcattttgttctccttttctattgttgctgtatttcagatttgctacatcttcttttcctgctccgttttcatgcacggtatcttttctttctgctccgttttcatatactgtatctttttgtactcagttcggattcgttgttcctgcatcttctcaaagccttctacctgcgtgggcgcgccaccacatagatccgctccgaatcctccttgaccggctcctttgtgaacgcgtcgtaggctgccagcaattccattcccgcatccgcaagcagtctgtcaatcgtctttaaatcataggcccgctgataatgcacttcctcaaaccggcggtaggttgcaccgtcctcgcggatataaagcgtcagatcgtattcatttacggcactctcctcatcgaaataattctcccagatgaagctgccctcctcgcggttttccgcaatcgtcgtctctcccagaagatcccggtacttgtataccgtattcaggtcaaaaataaagatgccatcctcctccagatactcgtgcacacgcgaaaacacctcgcgcagatccgcttcctccaaaatataattcatggaatcgcagaccgacaccaccgcgcacacgcttccgtacagttccagttcacgcatatcctcgagcagatagagaattcccccattgggcagctcgtccggttcatccggctcgcccagttctgcatattcttccggctcatcggtttcgtcagcttcgtcccatgcttctgccgcactccacgcatccgcctcatactctgcctcgcgtgcgatctcaagcatctcctcggaattgtccacgccgatcatatcgtaccctgccgccgccagcagcctggtcatttttccggtgccgcaacccagttccgcaaccgttccgctgcagatgccgtattcccggagcagccccataagataggaaccccattcctcatagggaacattatccataaacagatcatacactctcgcaaagctctcgtatgcacccatatcgttctcactttctcttccgccagcatgcggaacatttctatgtaatactaccaagtttccaatgtgaaatcaaggtttgccgacagattcccccgcacaaatcttcttgattatttttccggtaaaccgtatacttattccataaaatgctgttttttccgatgtttctggaaacacagcaaaatacagcaaaggatcttacacctatgcccgatcagtttgaacactatattaccaaaaatataaaggcattctacaagcgcagactgctgacaccgatcctgtatctgatttttcttctggtactgtggttcgttctctcgctgtcagcgccgctttttccggacacgctcgatgccccggataccctcgagagcacctacagacggcatgaagaatacatatccgccaccttatccgatctgaagttcaccggttacacccagtcctttctagggcacatcagcggttactactattacacgatgcggaatgacgagtgcatcatcgtgctgctctccccgaataccagtgaacagggacttccggagattccgcaggtgtccgtccgtgccaagattcttcacggttccgagaattttgatgagctgttaaatcatctcgcttcggatctgaactggaccgaaaacggcattcacaacaaagtctcccagtatgtactgagtgagcctgattacaatctgctcggaaacacgctgctctacgtcgtattttttgcgaccggcagctatgccctgatctgcattgtatttttcatcctctacatctgctttccaattctctcgcccgcgtgccaggatctcgcgctgttcggcaatccgaaaaagcttttggagcaggcagaggatgaacttgcgacgctgccgcagcttgcaacggaggatatgtttatcacagaacatttcttcatcgagacctcggtgtacggcaatgccattgtaccgatcgatgagatcatctggatctacaaatactcgacgctccacaagtttttctggtaccacttcagcatctcctacacgctgcatatcagtgcgaaccggcatctctacatccagtgcccgaagaacatcaagtcggacatcgacggtatcatagattacctcgccgaggcgaaccacaatattttagtcggattctccgaagcgaaccgtctgaaggtgcaggagatccagggaacgccgatgcattttgaaaaatttattgccatcctgaaaaagcgcgtctaaatcctgcgccaacacagaacggatcttttgcaatcagctctgagtgtcctttgagcgacaggtaatagttggagaagtacatcttacagatttcagatggaaatgcatatggaagattctttgtgaaaaaatgagagcatttcttcctgacggatatttgcatcggattccgtgtctcttccacgtttggacaatccaacgggaacatgtccgacacgccaaagacaatgggcggactttttagccgccctaactgtactccctcatagacaatataaaaccgcgcgaaccgaaactcgttgccatctgctattaaaaacaaggcagatggcaattcaaacatcggcttcgcgcggttatgtcttattgcgggagtacaggtaagggcggcacaaaagtcctacaaattgtcttcggagtgcggacatgacccgtggattgttccaaacttggaaagacacggatcatcgcggatgcaaatatccggctggttagaaatgccgcatttttgaacagaattttcatatgcattccatctgaaattgaaagatgtaatctttttatatattacctatcactcaaaggacactctgtgctgattgcaacaattcccctctgatgctagcggcaggaggtactgatcgactcaatcgccacagcaccgcctcttaccacttcgattctcttgaattttgagcggagcagggcaatcagttcgttgttgcgccgctctgtcagcttacattccagcagcacgctgtcgttcccgacgtccgatacctccacatggaacacctgcgctatctggaacacctcaagcttttccgccgcattgatgtctaataccttcgcaaacagaatctctttcatatggatcggcacatcggtgagatcaatgaccttgatgacctctaccatacggtttagctgctttttgatctgctcaaaggtaatgtcgtcactcgtcacgcagatcgtcatgcgggaaacggtctcgtcctccgtcgtgccgacggtcagactctgtaagttatacgatttgccggaaaacagaccggacaccttagccagaacaccgacctgattttccacatataatgcaatccagcgattcttcatagtaagtctccattcctatttcaagatcatttcactcatcggattcccgctcttcaccatcggaagcacgatctcatcggtggcgatcataaattcgatgatggtcggcgcctctttatatgtgcgcgcctcatctaacgccgcctggatatcctcctcgcgctccacacggattccgtgtgccccgtagctttttgcaagtgcgataaaatccggcgtgtacggcgggcaggatgcgttcggtcccttgcagttcgccgggcatccctttcttctgcgcagacaggttgcctcgtagcgcttgccgtagaataactgctgcatctgccgtaccattcccagataataattgttaaacacgcagatgatgaccggcgcctcctgcacgaccgccgtcgccatctcctgaatgttcatctgcagaccgccgtccccggaaaagcagaccacttccttgtccggattgccgatctttgcaccgattgccgccggaagcccgaatcccatcgtgccaagtcctcccgaggtaatcagctgatgccaggaatccagttccagatactgtgttgcccacatctgatgctgtcccacatccgtcacatagaccgcctctccgaacgtccggttcacatgctcaaaaatcatctgcggtgtcatgccgtgatccctgcgcatctcaagcggatttttctcatcccacccggcaatctgcgcctgccatgctgcggtgtctttggactccgcccactcgagcagcttctctaacgccagattggcatcggaaacaatcggaacatccacgaccacgtttcgggagatcgccgccgtatccacgtcgatatgtacgatcttcgccttcggcgcaaactcgtttaaatcgccggtgatgcggtcgttgaatctggtaccgatggaaaacagcacgtcacatttgctgactgccatatttgcggcatattttccgtgcataccgctgttccccacatagagcggatgcccggtcgggattgctccttttcccatgatcgtcgtcacaaccggaatctgcattttttccgcaaactgaagcagcttgtcgttggcatgtgcaatgttaatgcctccgcccgccagtataagcggcttcttcgccccgcgcagcagcttataagcttttttcagctgtcccacatgcacgctctcattcggtttgtaaccgcgaatctgcacactggaaggatactctgcaggtcctggcgccgtctggatgtccttcgggatatcgatgagcaccggtccgggcttccccgtggaggcaatgtagaacgccatcttgatgatgcgccccagatcctctcttttccgcaccgtcacgccgtacttggtgatgctccgcgtcatgcccacaatatctacctcctgaaacgcatcgtttccaatgagggataacggcacctgtccggtaaaacagaccagggggatgctgtcatagtgcgcgtctgcaagccccgtcatgatattggtggctcccggtccactcgtgaccagacacactcccacttttcccgtcgaccgggcatatccttccgcctcatggatcagcccctgctcatgtctgggtaagacgacttcgataccatcctgcttatatagttcatcaaaaagatccgtcaccgttccgcccggataaccgaacagggtggtaacgccttcttcctgcaaagctttcacaaataactttctgcctgtaatatccatgccgtcctccttaccttctctctgccgtccgtttcctgcagaaaggattattgtaaaaaactatagcccatctttttcacaaatgcaatcctatccaaagataaatcaagaatattaaaatacatcaagaacctttaccctatcaatcctactgtcttcaaaataaagatccatccggtcagggtaaacgctgccagaagcgttgtcatcacgatcacgctcgcggtgagtacaccgtcattgtccatgttcttcgccatgatatagcagctcggcgttgtcggagatgccagcataatcagaattgcgatcatctgctccccgtgaaatcccatccacgcagcaaccggcagaaaaatgagcggctggatgaccagcttgatcatggatgctgcaatcgtcgggcggatcttcgccagtgcttttcttccctcaaatcctgctccgatcgtgatgagtgccagaggcgttgccatctgtgccacgctgttcaccgtcttattcactatcaccggaaaatcgatgccaagaagtcccacgataagtccggtcaagattcccagaatgatcggattctttgcgatgttgatacaggcatccttaatcttctgcttcggatccacatccccggaatgtgccccttcaaacgtcagcacaatcacggaaaaaatattgtagagcggcactgcactcacgatcatgagcggtcccatcgccgagcttccgtacatgttctggatgaatgccagtcccatcaccgccgcactgctgcggaatgatgcctgcacaaaagctccccgcatgctctgatccttcaaaaacagcttcacaccaccccagatgatccagaagcacgccgtgctcacgagcgcgcagaacagcacataccggatgtcaaagaccgcccggatatctacgccggaaatatcgcggaacagcataaacggcagtgtcaccttaaagttgaaccggtttgccaccgtgacaaaattgtcgtttagcatcccgatctgttttaggatataaccgatcaccatgactaaaaagatcggaaatgttgcatccacactgtaaataaaattctccatctctacgccatcccgcctattttaccctctcgtaccggtaaaaataatactccagatcaaagtacgtctgctcctcgctatccgccgtgatcttccactccggtctctcatccagattcgggaaatacgcatctgcatcgtacgcatagtcaattttcgtgatgtgcgccacatcgcactcatccagaagctgtctgtagatcgtctctccgccgatcacatagatatcctcactgtcatatttttttaattcttcatgaagctcatccatgtcatgaacgacaaccgcacccggaaccttataggtatgatcgtgtgtcagcacgatattggtgcggttcttaagcggaagcccgttcggaaaactctccagcgtttttcttcccatgaccaccaccttgccggtcgtcgtctcacggaaaaacttctgatccgccggaattctcaccagtaactcatttttattgccgattgcccaattttgatccactgctgctattaaattcattttttacgcctttctattcgtgcttacaccgcgatcgggatatttttgatctgcgatcccgtcacgtaatcctcgatcgtgatatcctttgtcgtgaactggtaaaaatctttgacatccggattgagggtaaacttcggtgccggatgctgctctctcttgatcagttccctgataatcggcacatgccggtcataaatatgcgcatccgcgatgacatgtaccagttccccgaccttcatatcgcatacctgcgccagcatatgcatcagcaccgcatactggcagacgttccagttgttggcggcaagcacatcctgcgagcgctggtttaggatcgcgttgagtgtcagcttctcatctcccggctgatgcgtcacattgaacgtcatactgtatgcgcacggatatagattcatctcatgcagatccgcatgtacatagatgtttgtcatgatgcgccggctgaacggattattcttcagatcgtagatcacgcggtcaacctgatccatcatgccttccttgtactggtgcttcacgccgagctggtaaccgtatgcttttccgatggagccgtccgcgtccgcccactcatcccagaccgtgctgtttaagtcatgaatgttattggacttgcgctgccagatccagagcatctcctccgtgcaggtcctgatcgccgtcttgcggagcgtgatcgcagggaactcttttgagagatcatagcggttcaccacaccgaatttcttgatcgtataggcgctcgtcccatcctcccaatgtggtcttactttttccccctccgtgctggttccgttttccagtatatccttacacatatccacaaaaatcttatctgcgagactcattccgttcctcccgtttttcttccattctattctgctaattcttaattgtactcaattttccgtgaaatgacaaggtgcatttctgttgcatttttcccgcaaatgggttatattatttcttggaattttactttattttgcagagaataaagattgaacacataaaggagacagattatgagtcaggctaaagtagaccgctataaagaagagaaaaagaaccgcaagaagactatggcaaaggagaagcgcctgcatctgctcgctgttgtctgcggctggctggttgtcatcgcgctcgcaggctgggctggtgtgtccggttaccgcatctatgagagcaagaagccggttgagaccatttacgccaatgtcgatgccatcaccgattacatgaattccttaagcacagaagaataacgcaaaagaacccggggcgacttttccgcacccgggtatttttctgccatcctgcaatttttctatgtacgctcttctactctcccgtctctgcgccggagagttccgccttcgccagtgcattctcaatcgcgttcaacaataccactgatgtatactggtaatccgcattgtatgtaattccttccgtggtctgtttttccaccacctgatccgcaatgttttccaatgccggctccatcagcggatacattgtctccaccgtctcatcaagattgaccatggagacggactgaatccggttttcatccacaatcacctgcatatccaccgcatgctctccaaactggatcgatgacgtgtacactcccgccacatacctcattgtctctaccgactctccgtcctcttttccgggcaggaacatgaacagcagtaaaaaaatcagcagaattccaagtcctgcgaaaatcagtgtataaatcagttctttcatatgaagaaccacgatctttgtctttgcactcatcttaagcctccgcatactgattattacattatatgtggtgtactctttcccatgactgctttactctcaaaaacgctttaaaatcacaaattgttcaagtttttcaaaaaatataaaaaaaggcgttgacaaattttcattcacgctgtatgatatcaaatgtgtccggcagacataaccggcacaacaacttatgcgcgagtggctcagttggtggagcacgaccttgccaaggtcggggccgcgggttcgagtcccgtctcgcgctctcttttaacaaaaaggacatccgatggatgtccttttttgttaaatcgagtcctgccggaccaggtcgttcgaggtctacgctccgctccggtcgttgcctaacagcgtccaccggacgctggcttcttcgctacgcttcggtcggcgctctgctattgaaagccttggcaatttctggttaattaaccattggtcaaaaaatttttctcttattcaaactcattatgccccaggttatacttaacttattatagttaagtcttagttggatatggggcatatttctatatcaattacactatttattttgacctactgaatggacgttgccaatctgttgccacgagattattatagtttggattaggatgaaatgcaacagattctttaaaattagcactgttcaatatattctctcaaatacttaaacggaaatggaagaaccgtatattgactattacgcacaaattctactgccatcaacggaagagcctcctcatattcaagttcttctcccaaagaaatcaccttacgcatacaacaagcatttggatatgctaatctcttactcttagcccccacataatatacaaatgtacgtccatctaagtagtctttctcattgtattcgtacttgatgtttaagagatttccaatttggtaagtcgcttcaaattccccttttctcagctcgccatcaatccagactccatacttttcatgtaaaaacctattgaattttgatgcaatccctgtgcgcatatttaaaatctttttcattgctttcttggtaatcatttctgtttctgcagccaccttacttttccattcagaaatgcattcccttgaatcaatattatctttttcaaaatcatctattgcttccaataataattcttttgaaactctttcttttgcatccgtttccataagtgtattcattaatgctgatatattaggcaatgtcttttcgcgtgttaacaatatggcatgaatattatcaatatccgaatacattaatccttctaccggattctgtgcaccacgatgtttgtcttctacaaaatcatatgcataacaaatcttgttccactcttctgcttcatcttgattactatcacaaaatgtatcaaatttcatttcaccattgcaatcaatttccaaacgataatattggaaataattgagtgcctttttattaacatgatttatatgcgctgcattttcaccgtattttgtttttatcttctttctaagaacaaaggtccaatcttttccagaatcaagtctttcccaatcaaaaattgaaatcatgcgttctcttacatcaccttttattataagttcctgaacaatcttctttatatctggagaacttccctttgtatttgtaaaatgctcggcctcttctgttatatgctgtacaatatatccttttaagttatcactgtgtagatcatgcatctcattttcagcataatattcaccatcatgaatgattctgatattatatgcttcttccgaaagatttcctaccgctgcctttacatgataatacttctccaactcctcttggagctttgctacaatatcctttgatacttcagagttattttcatctacaattacaacaccctttttctgtaacatttcaccatattcaaactctgatattcccctcttttccaaattggagatatcaaattcttgtgcatcttccctctccacaatgtctatggacatatatttagaaagattatcattcacatctcttaaaaactgctccattacgcccatcttacttttcctaaaatgtgcaatatcagatatatcaaaattatctactctaaagtgattatgcggcaaggaaccttccttgtatgtaatgacattggtatctgtctttaatttttttctaaactcaccagtctttgaatctattacatacaatccgttactttctcgatcatatctcttgaaagttttatgttccaaattgagatacatccctggatcaataacaatctccaagaatctgataaaattcaccttacctgttaatttatctttatgtctccatgatgggtcatgatagaaaagcttacctgtgagattattatacataaaagcctcatgcttaggcgttctcattgaatttatcaggagttgtgcaagtaatctgttttcaaaataaaaacatttattgcactgctcgctatcaaacaaatcaatcttttggatttttacatcctcatactctttcataatactttctttaaattgcttttctgtcacctcacccttacggaacagcaccaatgcagttgcgccaaaggtccactgaactgctgccgccttaaattcatatactgccgaatctaagatattgtatttgtaataatccttattagacttctcgaccctaaaaatatcaaagtcagcatcaatattttctatattgtaggtaacattaattctgttagttaacattttcgaaatcctccttacaaatcatatgtaaattttcataacaaactgtaccatcttctcttataagcatcggaatctccaccaagcactgatccactatggcactcggcttgtaatttttatctgatacaacatttatgatataaacccgtttagcccctatagcctccaactttctcaatatatcttttctgatttcgtctctatcctgcacatatgtaaacttccaattcttaaaatcaacatacacatcatcagatagcttataatcgaagaattcaaaatattccggcactgttattggtgataattcaattcccaattctcttttcaatataaacttaccagccacttcgcccaatgcacctttataaatattatgaaacaacactggactaagaagatattcattcatttcaaatttcaatgcatatcccatttcttcaaaatgagctttcattccgggatatctaagtatcgcctgcaaaccggattccttttcactcatttcataaatagcaacttcatcagaattcccctttattttagctcttttactgtttttaaatgccaccttgtcgtttccaaaatctatagtaacatcattgaaatctgaatactgtgagtaaatatactggttccgcttttctccacttgtaatataaagtttttgaagatattcattattctgccagtcatatgtacttgccgtcggatactgtaataccaacgaccttaactgttcccacaactgcatactttcaatagtccaatcctttgccaacattcttcgaatcgtccaaagaccaaccgaggatatcttttccgccttattaagcataaggttttcgtccggaagataatcctttccaattgtctctcgcatagatacaattgctttcatttcaggtgataatatacgtttatttatttcaccaacatacaatttctctaacagttccgactcaacaaacaagtatatattaggactctttacaaatgttctacacatacgcccaactgcttgtaaaaccattcggctagcttgcacaactacactctttaacttatacaacttgtttaaagtgaattggtcacttcctgtataagaacgaaacgcaagctttaacatttggtccttttcagaataattcatttcaccgttctcgtataattcctcaatttgaaacaacatctgcaacaaatcatgagatgttattgtctcatcctgatatgtatttactgtcatattagttatatttcccagatacaatgcatcgaaatccttatataagaatctcttgtcaccttcggtaaactctcccagttgaacaacttttttacctttcagaatcttatattgtaaattctgtccagcacctatagtctgataagatgacataacaaatatcttttctccacatgacaatcgctgctgcaattcttccttatcttgttcaaaattgtcgcttttcaagaaacaaacactactattactctgctgtgtctccatctgagagtattcaaacaactgctgcagaacgccttcatccatgccgggattgttctttttcggcaatgccattcccaagtacaacattgattgaatatcttcattcctattaaaaatacacattgattgaagtacattgcagtatcttattatctgatattcgttatctgttatattggtgataatgtttgaagcataacgtgcaaattctgcatccataaatgttttgcaataatcttctgcattgaatccttgtatattactgctgattacttccccatgtacatttatctcgccatctgcataagcgctccatcttttttctaatgcagttcttgttttgtcctttaaataacccggcgtcttatgaaacctgtcttttaaccgctccttcaaatatctcaaatcataatttccaacaactgtatcaacttcagcagttgccgatatcccaaacacagttgcttttcctgcaaggtataacatgattttttcaggagtatcatataccttaacaaatttaagatttgtattgtcatgatgagaatcattatcctcaaattcataatactccatgccaacttgatagaagcttctatcctccaatatcagttcacgattatttctaatcatttggcaagtttcacccatcaacaaatctctttgcttattagttaattctaatctttttaggattgtactaatagcattctccaaattcatcgcatccatgataccgcttctggagctatttataatttccatgtaatttcttgcccattctatagaaaataacctaaaatgcaaaagaaatacattaatctcacgcaataaactatataacacaatatccttctctttgtttctgttcttgaaaaaatcatctttcccctcaaagaaaacatcaatacgattgtcttctttatttaaggatgagcggatatactgtgccccttcttttaaaaccgtatggaatgaaccatcattaaacaagaaaatctgtctctgatccactaaatcttctttggtttttatacttaaccttacatgataattctctgcaatttctcttgcttcatccattagtgttgtaaatgtatttctattccctaatttttcaacctcatccatagcttgtctcatactggaagaaaaatcgtttggattcaaagtacgatatatctgacgaaacaactgtatatagtcttcctgcattgccaatgacttatcaatcagctcactttgtatagtatccttcgttgcatcaaattcatcaataacaattactgcgttttctattaaatccgaattcaaaaactcataactggaatcaataagaatagaatttctcttcataaacttactgacactcattaatattattttgtaatcgtctgtaaatactgcaggatataattgcccaatccatttatatttagcatcagttctaatagcattttttcgctgtgtctttgtttgaaatctattctttaaatgtttagtaatttcatatcgaagctgcctgtccccttctgttattctgtcagccaattcttttatatattccttatcggcatatcttttttccacagcattacgataaagggaaacatccttgcataatttaagatacgcatccgttttcatttcctccggcacttcaatctcaagaattttttctacaacctcatcaaaattagagcgtaatctcaatatattacgcttataaagctcctcactcccatatgccgccctcaatgcatcttctggtaaattcttatttaaagttgtcaggtaaatgattttggtatcatcaccaattgaatccgcatattctttcattgcccgtgccgaatcataagtttttccattgcccgttggtaattcgcacatatacaaaccatgttcatgttgttgcataacatctaataagtaatctttcaacaccaaacctccttgtggttgcttatttcttgcatgattggtaacagtaaaattatatataattttatcatagaacggaaaaagaattgccgcatatttgcgtcaattctttttagaatatatttccatattttgttttatcaaatcagtcatagcattcctaacactctgtggttctaatacctctacatattgtaatcctaataaccatccaagcaagataacagacgcaactgcattaaaagtaactaacaacataccctctgtgtattccgaaattgtaatcctcttaccaaattgatctataaaaggaccaactaacgtatccggaattctcacagttattacctgttcttttcctgaaaacatacccatccgtcttgaaacatatgtattagcattaaaaatacggaactggcttttaccagctcttggtatatcggacaacttgatattatcaagtttatccactctataatttctttcacttaatacaccatctttttcttttacatcatatccatacaaataatacctatcatttgcccatattaaagcccaggggttcatgttatatcgtctatccgacttttttaccaacttcttatttctatcccacaccatataatcaaaacttatctgaacccccttagatagagcttcctgaatcaaatttacattatagagaattttcttattctctgcttttgcaatattaatccctaacacgcttctatccagttcttccgcatcatacagactcatagtagatttcaatttatcaatcattttggtggcaatacttttctcaatgaaattagacgcattaacggaatcaataataagtttcatctcttccttttccaaaagtctgtttccaatgaaataacgagcattccttccacgaccggaaattacatctacccctaattcatttcttaattgttttatatatcgcagaatactgtcttcactacagtaataaccttctgcatccatgtgaaccagaatatcttgcatagaaatctgatgttgttcgtctgtatatgctgtcagaatcttatataatgccaatactctgtttttttcgaaatcactcacaatttacctctttcttttattcaacaagatcaatcttatgtctttcacaccattgccttgctattttttcataagcttcatcacgatattggtaccactgtttctccagattcaagtcatacaatttatccttaaatcttctaaaagcgcctcttccttggattgcccctgccaatacattctgattctttccctccggaagctcgtatataaactcttccattattcgatactcgttgatatcgtattgtcccggtaacggtatataatcctcaacaaatccctctttgatatcttcaaaaagttccggattgtcctcaccatccaccattccatcaaacaacatcagaactttttcgttttgggtatcataataatattctgtttccataccggcaaattccattgcctcgattatgtcttctaattttactttcatcttttatccttatttcatgttcttttttaatttgttccctagcccgaggaacatttttagcatccatttgcattattctctaaaatatactttattctttgtttttccgtaacttttaagaatatccaattttgctgccttcgataacagtcgacttgccgtctttatttccgctttcaataattttgctgcaatagagctatttatttctttatttgtatcgagatagtgcaaaattatctgcattcttgtcctttccaattcggacattgattcggacattgattcagacattgtctcatttccttcaaaattttgagggacatcatagttcagattcggcatcactacagtaaactcatatctgtctgagcggaatgatggtcttttactctcattataattaatttgaaattcatatccactgataatctttccaaatccactacctttacgctccatatatccaagccggttgaatacatcggcaagaaccggatttcttctggtagaagctactgtaaatggatctctgtcttgaatcatggaaccatccggcattcctcccggggaataaatttccattctgtcatcatatatgtcaatatgcacttcacttccattcaccagatagtcacggtgagccaaagcattaacaagtgcttcgtgataacttcgctctacatactccggcatttcttctcttgaatttgcaatcttacgccacttcattttacaattacgcttgatgaatgcctctccattttcaatcagtgaaataacactacctgaatactccacatcatctaacgcatcaactgcgccaccacttttatttaatccattccaccttgtacaaaataatcttgaacaacgaatcggactttcatccgcaagtaatgcccctgcatttgttaattcgcaccgctcatttaccaatccaaatgaaatctttaccatcaaagctattccctatccacctaaattacttataataccttctctccttcacattcaaaggtatccttcaaaaaaatcctgtattctcttctttgtgtatttattctcaacttcttttaatatgtacatcgacaattcatttagcgaacgagtaagtgctacataaagcttattcttggtcttattcatctcggtattatcgtcaaataaatatgccgccaaatcgttagtaagaataaacaaacacttctcaccctccattccctttatgtagtctattgattttacaaaaatcttatcttcctgttttattgggctttcgtcttcaaaaatatttatgataatgccatatcttcttgaatctattttttcacacttgctcagtaatgccattgcatcttttttctttcccgtattcctgtacttttcaatcatcttcccagcataataatacgctactttttttactgtcagagtatctttggttggatgattctcagacaacaatggttcaagctcttccgctaaattctctctcatattatttttcttgtagtcatgcgtttcatataccccttgcttctgggatatatacatcaaatcatatttttgactttcaattaacgtgcgacaatcaatttcactttcataatatattgacaattgtccggaatctttttcagatttctgtttttcattttcatctactaaacgatttgacagttctaaatgtaattgcggacatctatggcattccgatatatatctaacattttgcttgtatatagacataagattccttaagcatttaaaaccttttaaatcctgttttggatctcccatcagcaacatggggattcccattctacttaattcttctataatttcttgcatatgcttatctatatcctgtacttcatctatacagattgcgccgcaatattttgcaattgcatttttaatgattactctgccattctttatactttttgtgtcctttgattttttacataacacccatttagcatgttcaggaattactgtttggtgaagtacattcaactcatcaagtcttttaatctttgcatttttatactttgcatcttggggtaaatccgaaatagaaattttttcatatttctttccataaagtaaatgataatacggttttattatttctctatacagaaatgaatgaatcgtactcactattatattttccgggatttgtacataatgttcacataattttctacgaatgcaatctacggcactattagtaaacgcaacgcaaaatattttcttattctcatctatttgattacgaagaagtattattttatctgacatctttgtagtctttcctgctccggcccccgctatatttatttccactttataacacctcttcctgctcttgagaaagaaaatctaatacatcttgaatatgtttgggcatttgaaatccttctaatccaccactagctaaatccttacaaatagtaaacatatctgatgcttttgcatttttccatgcttctgtaagctgctcagctgtcatattactccaaccgaaaacttctccatatttttccttcaaaatattaaagttgtcaccagtatttacaatttccggttctaaggtataatactctgttgtcctaacacatatttctttatcatcattatacttatcatgtcgtttctttgcatcaagttggtcatcataatctcgtataatgcccaatttgttacctgaaccttcattgatttttttccaaatattcattattttctcaaatcccttatggaatgatagcaattcaatctcactcaaagatacttgcgagtcaatataagagcgaattagtaattcttctgatattccctcaaacaaaacacatttcttagagaaaaaaagcttaaaaagatccaaattaggattctttgctaaatatgctatatcttcatcttctaattcgtcaacaaacgaaaatgcttttcccttatgtaaaaccaccacatttttcaaattcattttattaataaattcagtactatgcgtggagtagaataactgaacagttttattcttatctgtaaatgcttttagaaaactgaccatcaatctagtattgttaatgcataaatgagcttctggttcttcaatcgtcaaaacattcagagcagtatccgaatttttaccaatcaacgaattaatcagaacaaacaacaatactaagttacgatgtcccaacccttgcattgacagttcttcttctgaataccctaatcttacactgtttaaaatagattgcattggtggcatattaggaagaatattaatatgtgaaaaaaacttctttgcctcttttagctccgatgtatcttgccagtttattatgtcattgatatcactaattttttttaaagactcaaagaaatggctatattctttttctatttttaatttatcctgatctgaaagtccatctttcaataaatcaaccaaaaattttgaacctaattgatttttagttcttgaaaaatcgtctctttctgcctcaagagcctcatatttgaactgctttaatgtgtcatatgatatattactgccatcagaaacctttactgagtaattataatattctactggtaagagattcattttaacctcattcaaattcgcatcattgatttcattctcagatacaatttcctttaccattctgaatatatcttcacaactcttaggtgcaaactcatattttataccatattgaattttcccatctctaatttcatatgacaaatccttgacataatactcctccgcaccacttgcctgaatattaacttcaacacttactattggcaataattctacaaattgctcaatagtaatctcgtcattcttaattttattctggttttcaataattttattgtaataacactttttagtttcattatttatatcagaccatgataatttcttactgatatgtatattatcatcggttaaaaaaggaagcgtaattgcttttaagaaattactcttaccactattgttttctcctataattgcaactgtttctgctaagcctatgtctatattccttaaattcctataattgcatacttttacatgcgtaatcttcaaatcttcacttccttttcacaatacagctatcaattgttaagtagatatatttttaaataatgccttctccaatcactctttgtacttcctccgactttatcaacatcctcatcttctcactaccatcatcaatctcaggctttccacacctaagactatccgtatgttcagatacacaacaatccttataccagcattcacccataagctgccccttaacagaccacttctcgttttgtgtaaattcacccaccaatgatttcatcacacgctctgtagagtatctcttaaaacctgccaagtactgtaatgtcttctcatcatcaatctttgacaagttgattctatgattctcaattgctgataaaacctcttcacgaattttgattttatctgtctttccggtacctgtccatgccaccagcttatcaaaagcaagaatcaggtattcaaaacaaatcatatccagaatgataatcttcccttctgccttatcttctattgatttcaacatacgatacttattacgaatatcctgattatcaaccacacaatcaaacgcaatataatacttatcgtcctctttaatgtctatctctgccaatgcatccaataagccctgattgctttctttactttcgaccacaagtgcatcatcaaagaaaagctgattgactaacttccagaagtggagtccagcaccagtgtcttctgtccataaatatttcatatcacaactcctcttccagtgttatcctattattgccaaacttcagcaccttaaaactcttatctgaaacattgaggccatcacaatttcgtaggaaaagcatatattgattcgacggctcaaaattaataaaacgtctgatctcatcattaatcaaattatctgcattatcgactacaataaaactatctctgcactgttcaatcgattctgagaaattatctgatttgtagttaaacaactttatagctttgtattcattagttaatcgtagatcttctaacatttcataaagcactgtttttccagtaccactatctccaccaacaagagtaatcctgtcatcaaattctaaatcgtatgaaaatggatctgctttaaatgtaatattcttataaatcatctgcttctctcctttcatactccttactccaccaggcattataacctctccctccggtcactatatcagaatcattgaatctgatttgcacatcatccgggatatcaaaaagcgttggtctggacatgtaaatttttatattatccatagaaaaaatgattctaagtacattcggaccacattcttctacatttactaccttatcaggatgctttacgatattaagtaatgtcttgcagccagatgacaaattacggattgtacctaaaccatattttgtttcaatgtgcttgtctggtgtcagctttgcctcatctactttctgaatgagatttatttcatattgggacatttcttcattacttgtattcaaattgaaatacaaatcgttttgaagtatccagtcgttggaatcttttttttctgtatatatatatatcattcggtgtcactccttctctctatcataatcaggaacaaatgttgccatttcttcataatatccagcaatacaatttaagttatcacctatctttttgaatatctccacaaacatctctaaatcaacaacttcatttccataattttcgatataaaaatgatattcgtcatcggcattaaacggataccgtgaaaaatccatatttttcatctttgcattagcattatgatctttatctattttgtcatataattctaaaatatagtcgttcagttcttttgtcatttccttaaattgttttcgttgttctttatcggtttcaaaacctatcatacgtttctttactgtgttccatatttgcctgatatcgtgacctccacaaaatgactctttcatgttcagcaacatatccaaagaccagtttatagattttagatacaactctattgcatggtttgccgaaaacagcattgggaaaactacaatatccgcctttttatctccattatcctgcaaacaatcttgtgcaagcattatcgctgccttcatgtatccatcagcaataatcatcatatcatgaatgggttgatgctgtctggttctccaattcatatatgctgttttgtctatatctacattatacgaaaaaatcttttccattcattcacctacttttcaaaactatatatttaaatttctaaaatgcctaaaatctataaaatatcaaccaaataccttccaccaattaatgaaaataacacttttgatgaaaataatctttcacccatactggaaaacccagcaacagtcatagtccaatcactgtactcattcggcaatctataacatatcggcttatcattttcagagattgttactaatggggtcctattctgtgaaaatccaactgaaagaacataaaactcattctgtccactatgtaatggcaacataggttgcttgttaatatccttataaacctttgcgcctctttgattataaaaataatcttttccattttctactataggatcaatcggtaatttgttcctcattattttataacgttcgttcaagctctcgcagacaaaagcattataatattctggttgcatttctatcttactattacgaatctcatctgcatctgaaaaatgattcataaattgaagaagtgctacaaaagccaccaaatcatccgaataaattccagaaaaagatttgtaccaatagtcattattctcacaaattaccctatataattttttatacaaatcaagctgtctttgattcaatgcaaaccagcccgaatctaaaagtgtcttcttcattttcccatctttataatctccagttaacgatatcttcaatgattgcatcaatcgagatatcaatccagcaagaatatcagccattctgattccaacataatccttagaatcttcttcgatgacatttttaagtcctacattctttgcagaattcaatgtatgcgattcttttccttctcggtcaatcatcaactgatattcattaacattcatctctgtcaacaatttcttaaatccatcaaaaggtgcaaaataggaccaatctaatgtttcgggtacctctgtgtcctcaagcagtaaaagtatttcctgaaatgcttgattctcatgctctttcaaagcagtattcgcttgatttttaataatcctatcttctaaaaaagaccgtagttctttaacaaatatttgtggctctttataaattgcttctatcacattttgtggtcgatatacattgatagccttaattattgagtatttcatgtaatcaacatcaacaaacatagaattatgataatttacaaacagctggctaataacatactctattttgctaaacacagagaaataaataattattttctcgtcaaatagtgatacaaggtcttcatataactcaatcgtacgattattaagagaagcaaacccaagcctaaaatcttttgctttcatagtctgactctttaattctccgtctttttttctataatcatacttcgattcaaaagcaaggtatctgtcagaaatacatttatcatcttctgctttccaccctacaattcctgttatgaaattatcatagtaattattcgcggtaacagtttcataattaatctttctactatgttctgtttcatcatagaaaaaaatgtacttcatcttcagcacctccctactgattattttttgaatcaccataatgtatcgaatcttctgccaccttcatcaccttatactctggctcatattgataaatctttacagaattatctacttcattttcttcatcttctgttacggaatactcctcaaaattctccacctgttccataactttgttgaatacttccggactatactgtggtggataaccattcttcaccaagcagatttttatatcaagttttaattggttacgaacattctgattattgagccaatctgcaaatgaggattttgtatcggcaaatccaaagatggattcaaacatatttgtttcgttttttctgccattctgttacatatattattttggcccgctgattttctgttgccaatttgttgccacttcaaagcaagcatagcataagtgtttcacaatcgttattttgaaaagactgcatcatttctggaaagaagatatacacaatactggttcatgctaattccttctctttgcgaatgttctgccagtgatctgtgcaggctccgaggaattctcagcttaaactgaccggaataatcttccagactgtctggttcatgaatctccacgccatcttccaatgcagcttcaagccacgcctttttcgcatccagtgcattcgccaccgcactttctacagtttcaccacaggtaatgcagccaggcaaatccggataagaaaccacaaatccaccttcatctttatcttctacaatttccatacgataagacattgccatgtaatcattcagcgtcttcatcattcttcgcctcgctttctacaatctgccgcaccatttccacataaactttcttgattggttcatgcttcggtattgtaactggcatacagccctgttttctgaacgtataatgactgcttccgcttctcggtgcattcatctcatatccgtagctttccaatattccgcaactcttcaaaccggaggtctttcgataaattgcatatatgtgttatcagtttatcccactttgacattctttatatctcttgattttattttatgtggtatcgcatttggtgtcaacttttttattgtatgtcgcctaaaaatctgcataaatatttcaaatttagtgttgacaaattgtaactcatgttgtatgatatcaaatgtgtctggcagacataaccgacacaacaacctatgcgcgagtggctcagttggtggagcacgaccttgccaaggtcggggccgcgggttcgagtcccgtctcgcgctctcttttaataaaaagggcatccgatggatgtccttttttgttaaatcgagtcctgccggactcgaacattcgagtttcttcgctccggtccggtcgttgcctaacagcgtccaccggacgctgacttcttcgctccgctccggtccgcgcagaacagacgtccactggacgtcttgcttctccgttctactccggtcgttgcctaacagcgtccaccggacgctgacttcttcgctccgctccggtccgcgcagaacagataaatctatttgcccttgtctaatggcataatgatatttcgttaaaagttaaatcaaaaaagacatcaaattctacctgtcaaagtagattgatgtctatttttacctataaaaaatgggcactgccatatcagcggctgccacacaggcagcttatgttacatatattcacacactaatatgggcttacatacccctcaaatttctattggtgtcctaacatatagtatgtgaaaatacaagcgtttattcccattctgctccgtattttataccaatattttcaacactatatgtcttattttccgaactttcttgaatgacattcggcttccgatggatgtcatttttccataccgagtccttctcctttacttgcaggacttacaatacagttccgcccacatcggcacaaatcccgccccaagtgctactctctgcgatgctatatgtgacattgaggtgccataaaacggaagtttcccgcgctttaagatctcgtttttcaggaccgcaacaagcatggaacctattccaagtccttctgcctccggcatcacattaattccaatctgccacatgctgtcgctgtcgcttgtagcgcccgccatgccaagaaggacgccatctctgtaagctcctaccccaatttcatccttgggcagctcatgaaagagaaatgcttctccaaagcgttcatctcctctgaatggctccagttcttctccctcaaagattcggatctcataatctttcgtgtctacctcggacatttcggtcgcaatataaaatggatgagcctgtgcaatctggcagtggaacatttttaaacctgcttccagctcatgtaaagcttccacgtccatgaaccaggcgccgcttctgtctttaaatgtttccctcacccatgcaataatatccttcttaccggatgcaagaatcttgccattgatgcaggcaatcttcagaaaacattccccttcttcaaaaatcctgcgtccctgcagcggggtatacaccgtgaagatattttccctgctggtaactgctccttcctctgtacagaaatcaatcgccagctgctttaccaatatctcgttcatacttttccacaattcttttctctctccgccatccagcgctctttcgtcattatatttcgatgttcggtacgcgcttccttcattaacggcacggataccttttcccgtgtgtgatgatatacaaagccaatcttctcctgcactctttttgacttctgattgccctcaaaatatccgcaccatatggtattcatgccgagatcttcaaatccatgacggatcatttctcttgctgcctccggcatatagcctcttccccagaaaggttttccaagccagtaccccagctcacattcctcgtcatgattttccgtatcgttatgtctgtttaatatcagttcaatcgcaccgattgcttttggatttcccttttcgcagatcgcatagcactctctgccgtttagtacattccggatcacatccaggctttcctctcttgaccggtgcggcggccatcctgcaatcggaccaacctccgggtcttttgcatattcaaataaactgtccgcgtcttcctctgtccactttctcaatagcagccgttccgtttctaacatatcgtattcctttccattccctgccgcgtaaacctgcccgctttccaaacagaaacggttctactccgcacactgttcttttgcttcggcatcgggtcctaacattcccagcttaaaatgtcttctgcagagcgccacatagctgtcgtttgctcctaacatgacctgcgggccagagcgcacaataccatgctcgttgtatctcgtattacaggtagcttttctgccgcaccagcacaccgtctttaactcctggatcacatccgcaatcgcaatcagacgctcactcccagggaacagcaggttacggaaatctgcgcgcagtccataacagaccaccggcacatccataaaatccacaatatcagacagaaaatccacctgctgcggcgtggcaaactgcacctcgtctacaatgatgcagtcatatccgcgaatctcctcctccttcatctgctgcagttcttctaacagaatgcagtcatgttgaagcccgatccttgaatataccgtccgctcgccatctctggcatcgatcgccggtttacataacagcgctttctgtcccacttcctcatagttaaaatgcgtcatcagcgcatttgccgtcttagaacttcccattgcaccatagtaataatataattttgccatcaatccaccctctgtcgctgcctgccgcccacttcctgcatacagtcattttcttattaaaaagcgctgtgcgccacttctatccattatacctgtacttttctgcaccggcaagtacctttccattctcccgtgtccacattccatttctcccgtgtccacattccattcttcttgcacaccacccattttttcgctataatatcttgtgcacgatttacgaaaggcataggatgatgatatatgaataaaaaagatatcttggagttaaaaagacgttttaaaaaagatgcctgcaccttcaccagactctgcggctgctacgtcgacgcagaccgcaacaaggtcacaaccttcggggagaccttcttaaatctggaggatgaggaattctataaatacctggaaattgccaaaaaggttatgtccggcacgatcgacaacaacattctggaactggaatttccgactgccgaggaagcaccgggcggaagacagcagtttttgatgggtctgcgcgagagcgcattaaaaaacgatgacctcatggacaccttctatgatcttgtcattgagaattacagttatgtcgggaattatctgattctggtgttccatgatgcctatgatgtgatgacgaagacctccgacaacaataagctggacgagtccgaggaagtctacgagtatctgctgtgcgccatctgtccggttaccctgaccaagccgggacttggctaccgcgaggacgagaaccgcatcgggccgcgcatccgcgactgggtggtcggcgttccggacaccggtttcgtttttccggcatttaccgaccgcagcagcgatattcactccgtgatgttctacaccagggataccaagacaccgcacgcggaattcatggaatccggtctcggctgtggcaccaagctgaccgccaccgagaaaaagctgacattccagagcatcgtcaaagaagtcatcggtgaggatgaggaagagagcgacgctgtcttcggggatatccaggaaaatctgaacaatatgattccggtcacggaggacgagacggtggaaccggaaccggtcatcgtcaccagatccgccattgcagatgtccttgcagaaagcggtgtcaccgaggaacaggcagccgtcattgagaacacctatgaaaatgtatttggcgaggaacttccggaagccggacagttagttgatccgaagcttgtggaagccaacggaaagcgcaaagaaaagctggagctggtaaagcaggtggaaaacttaaagcaacagctcgaggagacgcgctccgttccggtctcggagggagatgccgatggcgaagatgtccctgccgtcaagacctacgatgtcatcctgcgcgtcaagccggaaaaagtcggacagattcactcccaggtcatcgacgggcagaaatgtctggtcattccgatggacgaagatgagcacgccgctgtcaacggtgtcaataccaccgtataatacggatcgatgcaatcgatgacgcatggaatatgttccataccggcagaagccagcagtgacggcattcatgccaccgtatcctattttgcataaaacccgtcatgaaatgatttcctttctcatttcatgacgggtttttcataacaatcctgtttcagacgcaggcacagcgtttattgcgtcagccgctctctgatatactgctccatctcatccttcggtatgccgagtgtgagcgagagttcactgtacagttcattctccgctgtccgcatgtagcgctcgtccagcgccgtgatcttctttccctgtgccgtgcgctcctgttttctgatgtatagtgtctttacaatgctgacccacgcacggtaatcgcaggtgttcattgcctccttgtatctcgcctctctctgcctgtcatccggcacccagagctgctcgatcttaggcatatcctcaatcagctgatccgcttcctccctggaaatcactttgcgcatcgtaatcttctgattgtccgtcggtgcatagatccttccactgccatcgccaaccggggcaagaacataatacaaacggtctttatccgccccggaaatgtcaatgtgggtaatatcctcaatccggcatacacccttcactccatacacaatatactcaccgatctcaaacatcttccccgattctcctttcatcacagttttaaagcatccatttctattttaacacgaaaaatcccgatttaatcaatattttccgcttttttccaattttcgtaactattgccagaaaacaggcggcgtatgattgtacatatttgccaaaataggaagtaaaaaagactcctgtcacagaatttttgcgccgggcgcggtcatgcggcatgcttccaatttgcgcggtcacgcatcttcacaacgtatttttgtgtgacagggatgaattctcccaatcgagtaggaggcggtgtgttgttcacgtctgtccaaaatctctgcatccgctttttcaaattgttcgaacagagccttttgttgttctgtttcgagatgcacaacagtttcaagcaatttgtctttgtctgtgccgtttaatatacgttgcactatttttttagcatgagcatctttatacgatcttaatacagcaaaccagatcattacaccttttttttgtatttcacgttatactctttgtaaacaagcagaaaaaggagaagtatatatgcttgaaattatacatagaaaaaaacggctgtcatcctttaagctgatcgctctgggttttgccggagtcattgtacttggagcacttatcttgatgctaccattttcatcaaacaccggatctgttacaccatttcatgaggcactgttcacttcaacctccgctgtttgcgttacggggcttgttgtgcaggatacaggcagctattggtccgctttcgggcaggcggtgattttgctgcttattcagataggcggacttggcgttgtgacggttgctgcaacatttgccatgctttccggcagaaaaatatcgctgatgcaacgcagcaccatgcaggatgccatttcagccccaaaagtcggcggcatcgttcgcctgactcgctttattgtacgtgggacttttctgatcgaacttatcggaatggttgccatgctaccggtattttgcagagatcacggtttcaaaggaatttggatggcggcgtttcattcggtctccgctttttgcaatgcaggattcgacatactcggcaccaccgaaaacaaatatccatctcttacgggatacgtcggagagccgacaataaacattgtaattatgattttaatcatcgtgggcggcattggctttttgacttgggatgatatctgtacaaacaggtggcatttcaaaaaataccgtatgcaaagcaaggtaatattagtaacatcggtgattcttattatcgtccccgcaatattttttttcctcttcgatttcacaggactgccgcccggtgagaagatccttgcctcgctttttcagtctgtcacaccgagaaccgccggattcaacaccgccgaccttaccgccatgactgaatcttccaaagcaattatgatcctgctgatgcttgtcggcggctcacccggttccaccgccggcggtataaaaacgactacgcttgccgttctgatcttgaacgcattttccgtctgccgtaaaaaaaacgatactgaagtctatggcagacggcttgaatgctcggcggtaaaaagcgcctcaaccatcgccgtaatatatttcctgttattttttatcggcggcattattatcagcacggcagaaggcatgccgcttagcgcctgcctttacgaaacggcatccgccgtcggaacggtcggccttacgctcggcgtaacgccgcagctcagtgttttttctcagtttattttgatcgtcttaatgtatctgggaagagtcggtggacttaccctgatctatgcggcgatctctaataaaaatcagagcggtgcaaaactgccgctcgaaaagatcacagtcggataaaggagttactgttatgaaaaacatattgttgataggtctcggcagattcggtaagcatattgctttacaactgaacaaactcgggcatgaggtgatggcagtagacagcaacgaagaaagaataaatgaaatcctgccgatcgtcaccaatgcacagatcggcgacagcacaaatacggagtttttaaagtcgctcggtatcggcaactttgatgtatgtatcgtcaccatcggaggtaattttcaaaactcacttgaaactacttctttgctgaaagaactcggtgcaaaattagttgtgtcccgcgccgagcgtgatgtacaggcaaaattccttctgcgcaacggagcggacgaggtcgtttacccggaaaaacaggtggcaaaatgggcttctattcggtataccgccgaccacattcgggattacatcgaggttgatgattctcatgccatttttgaagtagaggtaccagaggaatggatcggcaaaaccgtcggagagctcgacatccgcaggaaatacagcatcaatattatggcgactaaggagaacagaaaaatcaatatggcagtctcgccggaaactgttcttacagacaagatcacacttttggttctcggtgcttataaagagctgcaaaagtgttttcgcatttaatagaggtgaacggcattggctgaactattgctgattatcagcttgcttggcgtatttgctttcggcttttatcttatgagcaggctggaccaatttcttgagaaaaacaggaaggcgctgttaaaagagaacaaattccgtgagttttccgaaattttgctgccgcaaggactgtccgacagtgagatattaagcgagatccgccattttcgggaaacacacggaaaagtcgatattatcctttctgacggaaaagaggatgcgttttagtttacggtagaagatttcacgattttgttgtataatgaaaccaaaaaggcggtgaaaccgatgcaaatacaaaccgaacagccaaaaaacggtgcggacgagcatatccttgtctgcctttcctcttcaccgtccaatgcacggatcatacataccgccgcaaagatggctaaggttcttcatgcaaaatttaccgccatctatgtgcaaaccgattcggttgaaagcgaaaaaaatcggctgcggcttgaacaaaacattcagcttgcgcaagggcttggcgctgagatcattatgacgcacggcgaggatgtgccgctacagatttcggaatatgtccggctttcagatgtgaccaaaatcgtgatcggacaaagcagcgcccgccgcagaggactgtttggaaaacccaccctaactgaaaaactgatttcggtcgctcccaatgtggatattcatatcattccagacgcactgaactatgtaagaccgcaccggcgccgtttgcttttcggtgcagaaacaccttcgttgcgggatattggcgtgaccgttctgtcacttgccgtatgcacggcgatcggttttttgttcgatcatctcgatttccccgacacaaatatcgttacggtctacattctcggcgtactgatggtctccgttttgaccaaaggatatctttgcagtatggcaggctcgcttttaagtgttgtattgttcggatttttccttaccgaaccacagctatcattcaaaacctatgctgtaggctatcccgttacctttgccgtcatgctggtagcttccgttctcaccggcacgcttgcctcgaagcttaaggatcatgcgagactttcagctcgttctgcgttccgcacgcaggtgctgttcgacaccgaccgtctgctgcaaaaagcgaaaagcaacgatgatatcttaagtgtgacctgtatgcagctctcccggctgcttgaccgcagtattgttgcttatacaaaaagtgaaaatggaatgtcgaccggacggcttttcgccgaaaaaaagtacacatactctgaaaatctgctgaacgctgcagaacagaaagccgcagaatgggcatttcaaaacggtcgccgtacaggagcaacaacagcacagttcggaaaatccgaatgtctttatcttgcgatccgtgcagggagcagagtctatggagtgatcggaataccgatgagacctgaaaagcccgattcattcgaaaacagcatcgtgctgtcagttgtgaacgaatgtgctctggcaatggataatacacacaacgctgctgaaaaagaacgggcagcagatcttgcaaaaagcgagcagctgcgcgccgaccttttgaggtcgatctcacatgatctacgcacgcctctttgctcgatttcaggcaatgcggacacacttttgcataacggaaactgcttggacgaaacgacaaagcaacagatatataaagatatatatgacgattccgagtggctgattgacgtagtggaaaatctgttgtatgttacacggctgaatgacggacgcctgaagctggagcttaccaaccagcttgtagacgaagtgatcagtgaagccgtttcacatttgaagcagaagtctgtcgggcacacggtaacggtgaagtgtgacgatttgattcttgcacgcatggacgcacagcttatcgtacaggtcatcgtcaatcttatcgacaacgctttgaaatataccgaacaaggctcggagatctgcgtaagtgcagaaaagcaaggaaaatacgccgtgatccgtgttgcagataacggtagcggaatccccgacgatatgaaatcgcatatttttgaaatgttttacactggaaaaagtacagttgccgacagccgcagaagctttgggatcggtcttaccttatgcaaatcgatcgtagaactgcacggcggaacgctgacgcttagggataatgtgccgtgcggctgtgtatttacctttactttaccgcttagcgaggtgactctgaatgaataaaccgcttatacttgttgtggaagacgaccgcccagtccgcaatctgatcgtaacaacattaaagtcgcacgattaccgttatctgactgcggagaacggacatggtgcgattatggaggcgacctcccataaccctgatatcgttctgctggatctgggtctaccggatattgacggcacacaggtgatcgaaagcatccgctcatggtcgaatatgcccattattgtgatcagtgcgcgtagcgaggatcgtgataaaattatggcacttgacgccggggcggatgactatttgacaaagccattttccgtagaagagcttttggcacggcttcgtgtcacacaaagaaggctgttgctcctgcaagcaagtggcgatgccgacaccccaatttttgaaaacggcgagcttaaaattgattatgccgctggttgcgcttacttaaaaggggaagaattgcatcttaccccgattgaatacaagcttttatgtctgctctcccataatgtcggaaaggttctgacgcacacctatatcacacagcagatctggggcagcagctgggaaaacgatattgcctcgctgcgggtgtttatggcgacactgcgtaaaaaactggagctgcaaaaggacagtccgcaatacattcagacgcatatcggcgttggttatcggatgctgcgggtagactgagaaaagcgagaaaacaagaaattgaaccgatatgcaatagaaaatcctttcggaattcaagagcgcaatatccgcttggtacggaatcatcatcacctacggtatggtgcttggttttgctgtggcaatataccgtttgattttcgaatgggataataacaaaaacgacctgctttctgttttagtagtcaatccaggcggccttgccatttacggcgaagtacttggcggtgtcgtagttgcattgatttaccgtaaagaaaaacggatttccccttttgggcgcttcactcaccgttaatatcacaggtgctgtccggctacctgattattttcggtatcgttacaatttttattatctgtaaaagaaaggcgatgcggcaatgagaaaagaatggactttattttttacctttcttaaaatcggcgcttttaccttcggcggcggatatgctatgattgcgttgcttgaaaacgaatttgtagaacgcaagaagtggatcaaaaaggacgactttctgaatatggtagccattgccgagtctacacccggaccggttgcaatcaacagcgccacatatatcggctacaaaattgcaggcttgttcggtgctgcggcggctaccgtggcggtttgtattccttcgtttaccgtaattttttgcatctcactgttttttgatcaattcttaagccttacatgggtttcccgtgctttccgcggaatacaggtatgtgtgatctatctgatttcctctgccgggctgaaaatgctgaaaaccattgaaagaaatgccttcaacacggtcattttgctgtcggtcattgctgcaatgctggcgtgcactgttttcgccgtttctttttcttccgtttactatattctgatttgcggtacagcaggacttgcgattttcttcctgaaaaaactgcggaaaggaaacggcaattaacaatgatctacctgaaattattcctgaattttttaatgatcggtgccctttccttcggcggcggatacggaatggtttcccttgtaagagaaacagtcatttcaaacggctggctaacggaaagcgaattcttaaatttcattgccgtttcggaatcgacgcccggtccgcttgccgttaatatggcgacatttataggttccacgcaaggtggcattctcggctcgtttcttgctacgctcggcgttgttcttccgtctttcattattatacttttaattgcggcggtactcaaaaacctgatgaaatatgccggtgtcaacgcttttctctccggcgtccgcccctgcgttatcgcaatgattctcgctacggcaatcggtatggccatatcaacattgcttggttttacggatatttattcggcgcttgctccggatcctaaatccattttggtctttgccattctgtggctgacacatttcggatataaaagaatcaaaaaaactgcaccgtcgtcgattataatgatactcttttctgccgcactcggcatactgctttggggagtataaaatgcatcctatgccaatttgccgtccgggaatcgggcggctttgctaattgtttggggatgcactgttcgtcacctgtctgaacgattatctggagtaaaactcagagataaacgtcgcggaaacctttgaggtttatgcagaaaatgaatttaagtatggaacatacaacgaagaacaaaactcacgtttagcatcaggacataatctaaagcctgttacaaccaatttcacaggacgcaaaccagatgaaatatatgcggattttgtttttatagatgctggtaaatatctcatcaaatgtaagaacaattgtgtacctgaagaacgtatttttctaaaaacatgggtgcgaaaggaagtattttggaaatccgttggttgtacaaagcaattacatacatgcaaacagaagaattctctgaatactcataatttagaaatagaattgaggcaatttcatctcttctccgccaaaggtatcatgtgaataggaaagatattagattataccaatagcttagattcgtatgcttcaaataagaaaacagcataaaatcaatgaaccacagtttcaaaatatcaataaattataggctcaaaaattatatctttcacaaattcgtgttaaattttcaaggtacaaacaacctcaaatattaaactgtactttcggcaccctaatcccataaagtcaaaaagcgccccgcaatgcggggcgctctcttctgcacagctcaaatgggtaaaaattcactgtgctgcagactgtggcagggaaaccacagcctcttggtatattaaattagggaaaggaattaacttaaattatttgaaatgacagcttacgctattatctctgtacacgtccggaagcatcgccgccagccagtttcttgacctcgtcaacgcttaccatgttgaagtcaccctcaacagaatgctttaagcagcttgctgctactgcaaactcgatcgtagactgcggatcgtagtcgtttaagcaagcgtagatcagtccgccgccgaaggaatcgccgccgccgacacggtcaacgatgtgcattaagtactccttggagaagtagctctgaccatcctcgtaaagcattgctgcccaacggttatcgtttgcggagatggaagttcttaatgtgattgcaaccttcttgaatccaaaacggtctgttaacttctgtgcaacctctttgtagccttccttgttcagttcgcctgcggtaacctctgtaccctcagacttgatgccgaatacgtcgtttgcatcttcctcgttggagatacatacgtctacatacttgcaaagctcgcccatcacctgtccggctttctccttggaccacagcttgttgcggtagtttaagtcgcagcttacagtaatgcccttagcctttgcagccttgcatgcctctaagcagattgctgcaacgttgtcaccaagtgcaggagtgattcctgtgaagtggaaccagtcagcaccgtcaaaaatcttatcccagtcaaaatcagcagtcgttgctgttgcaatggaagaacctgcgcggtcataaataaccttggacggtctctggcttgcacccttctcaaggaagtagatacctacacggtcaccgccgcgaacgatatcggaagtgtctacaccgtactgtcttaatgcattcacaccagcctgtccgatctcatgagccggaagctttgtaacaaagcttgcatccattccgtagtttgcaagagatactgcaacgtttgcctcaccgccgccgtaagtagcgccgtaggtaccagcctgtacaaaacgatagtatccttccggtgcaagacgaagcataatctcaccaaatgtaacgactttctttgccattattgaatcctcctaaatgtatgtttcaccatgtgaaaccgtgtttcattttctataataaaattataacatctaataccagaatgtcaaatatgtttttatttaagtccaaaaaaattccaaattatttccgattttcacttttctattttagcaggatgatatataataaaaacagattggttcacattacagaactatgtttcgcaatgtggaacatacatatcgtatccatagacacagtgtgctgcattttctcataaagcattctttttgagatgccgtgacgtgtcggaatttttactttcttatttattcttacatcatcaggaggagattatttatggaccgtaaatacgatgtcatcactttgggggagattttactccggctttccacgccgatcaacggacgtcttgcacagggcgacacgctgatgaagcacctcggcggtgccgagctcaacattgcttccgagatcggacagctcggccttaagacagcaatcatttcaaagattccgaacaacctgctggccgctttcatcaagaaccagctcaacgcttcccgcgtcagcgagaattatctgatcgaggatcactcggacgacagccgcgtcggcatctactactatgagtacggctcctacccgagaaagccgcgtgtggtctatgacagaaaacattcatccatcaacaatattgacatcaaggacgttccggctaccatgttctacaataccaggctgttccacaccagcggtatcactttaggactcggcggcaacgcacagaagttcgcgatcgaatgtatccgcaagttcaaggagaacggcaccctgatctccttcgatgtcaactaccgcgcaaacctctggagcggcgaggaggcaagaaaatgcatcgaatccatccttccgtatgtcgacatctttttctgctccgccgacactgcccggctgaccttcggcaagaccggcacgattgaggagatccagaagtccttctgtgaagaatatccgatctccgtggttgcctcgactgagcgcactgtcatcactccgaagaagcacgactttacctccatcatctactctgcgaaggaagaccgctactacagtgaatctccttacaacagcatcgatgtggtcgaccggatcggaagcggtgacgcctacgtctccggcgctctctacggttacctgagacatcacgactgtcagaaaatgttggagtacggcaacgccatggcagccatcaagcacagcgtcatcggcgatatggtctttaccgatctcgaggagatcgacggcatcatcgcacagcacaaggatacttccggattccagcctgagatgaaccgctaagtatcattttcctgcgaaggaatgaagcgtgcgcctgccgcacactttgcgcggcagataaaaaaatgatggcggcagtcccgcggatactctccgccggactgccgccgtttttattctgaatcttctctatggttccgccgccggctcctttcatcagagccggctcttttccggaatcacgatctttttctcttctgtcgaaggagaacgttcctcatccgcctccggagcatttccggtgcggtgtctcttcacattttcgcaaccagtgcatccggcacggtgatgtgatccagatgccagatctcatccacatactcctgaattgtgcggtcggaagagaatttgcctgcgtgggccgtatttaaaatagcgctcttcgcccatgcctgcttatcctgatagtactccacaatccgcttctgcgcatccacataggaacggaaatccttgaggataaaatacgtgtctgcatactgcgtgcactgcgtgttgagcagtgaattgtagagatcacggaacaaccccggatcgttcggcgaaaatgtgccgtccacaagctgatttaccaccttgcggataccctcgtcgctgttgtagatctgcatcggatcataatcgcggttgcgctcatgcgcaatgacttcctcggagctcatgccgaaaatgaaaatattctccattccgacttcctctgccatctccacgttcgcgccgtccatggtaccgagtgtcagcgcaccgtttaacatgaacttcatattgccggtaccggatgcctccttgctggcagtcgaaatctgctcgctgacatccgccgctgcgaagatccactccgcattggacacgcggtaatcctcgatgaatacgaccttgatctttcctttaatgtccgcatcgttgttgatgacgtccgccacactgttgatgagcttgatcgtaagcttggcgttccgatatcctgccgccgctttcgcgccgaaaataaaggttctcgggtagaaatccatctgcggatttgcctttaactcattgtacaggtacatcacatgcagaatattcaagaactgtctcttatactcatgcagacgctttacctgcacatcgaaaatggaatccggatcgacttcgatgccgttatgctccttgatatactctgccaggcgcactttgttcctgcgcttgatctccatgaactccttctgggcttttgcgtccgatgcatacggaaccagacgtgcaagctgcatcagctctgtgatccagccgtcaccgatatgctttgtcacccagtcggcaagcagcggattgccgtgcatcaggaaacgtctctgcgtgatgccgttggtcttgttgttgaacttctccgggaacatctcataaaaatcatgaagctgctcgttctttaagatctccgtgtgcagtcttgccacaccgttgacggaataaccggctacaatggcgagatgcgccatcttcacctgaccgtcgtaaaggattgccatgcgggcaaccttgccgtcatcccccgggtagcgttcctggatctgcagtacaaaacggcggttgatctcatccacgatctggtagattctcggaagcagccgctgaaaaatctcaatcggccatttttccagtgcttccgccatgatcgtatggttggtgtaggcacaggtcttcgtggtaatctcccacgcctcgtcccagccgagaccttcctcatccacaagaatacgcatcagctctgccaccgtcaccgtcgggtgtgtgtcgttcaactggaacgtcaccttctccggcagtctgcggatgtcatcatgattcttcttgtaacgcgccagcgcgcgctgtacactcgcagatacgaagaaatactgctgctttaagcggagctccttgcccgcaacatgattgtcgttcgggtaaagcacttccaccagatttcttgcaagattctgctgctcgaccgccttctgataatctcccttatcaaatgaatccagctcaaaataatcctttgccgccgcatcccagatcattaacgtattgaccacgttgttgccgtatccgaccaccggcatgtcatacgggatcgccagcaccgactgataatcctcctgcacaaaacgcaggcttccatcctccctgctctccgtgcgtacatgtccgccaaacttgatctcgtaagtgtactccggtctgtgcagttcaaacggataaccatttttcagccagttatcaggcacttcgacctgaaagccgtcctgaatcttctgcttgaacataccgtagcgataacggatcccgcagccgtaagctgcgtatccgagtgtggagagggaatccataaagcaggcagccagtcttcccagaccaccgttgccgagtgccggatccggctcctgatcttcgatcacatcgagattcaggccgatctcatccagcgcttcccttacttctttatattccttcagattgatcagattattgccgagcgcgcgtcccatcagaaattccatcgacatgtagtacacgatctttggatcttccttgtcaaatacctgctgtgttgcaagccatctgtcattgatgacatccttgaccgcgaaggagaccgcctggaaaatttcctgctgatccgcctcctccaatgtcttgcggtataaattcttcagattatcgcgcacactctgaataaaggctttcttgtcaaaaacacctgatttcatctagtttcctccttttttcactcccagaagaacatgttcgccgttaatattccattccttgctgtaaacttccggctcatccgcaaatgctccggctgtatccgccacgacattcacgccgagaacgtccgatttaattgtatcaccatactgctcaaaaataccagatactttttcatctgacttgtgatagatcgtgatctgatccatcacctcgaatccggcttccttacgcatggtctggatcttgctgatgatctcacgcacaaagccctcctcgataagttccggtgtcaggttcgtatcgagcaccactgtcacggtgttatctccctcggtcacataaccttccatctgcgttatggtgatcaggagatcctcctctgccagcttgacagactcgtcaacggacggaagtgcaagcacgccgtttgcctttaattctgccatcgccgcattgccgtcaagcgctgcgagtgctttctggatctgtcctaagaacttgccgtacttcggtccgacggtgcgcagctgcggcttgaacgtgtagcttgtgtaagcgctcacgtcgtctgtaaatgtcacttttttcacattcagctcatcctcgatgatctccacgaagaactccggcagtgcagacggagcttttacgaacatgtttccgatcggctgacggttcttgatgttcgcggaattacggcatgcacggcccatgacaacgatctttaagacctcatccatatttttctcaagctctgcatcgatgtacacctcgtttgccaccggaaaatcgcacagatgaatgctctccggagccgtctgatccacggagcgcaccagattctgatagatatcctctgtcataaacggaatcatcggcgccgcacacttgcagatcgtcacaagcgctgtgtagagtgtcatgtacgcgttgatcttatcctgctccatgccctttgcccagaaacgctcacggcttcttctgacgtaccagttgctcatgtcatcgacgaaatcatccagcgctcttgcagcctccggaatgcggtaattggaaaggttgttatccacttccttaatcaccgtattcagcttggagagcagccatttgtccatcacggaaagcttctcataggcaagcacatattttgatgcatcaaaattgtcaatgttcgcatacagcacgaaaaacgcgtaggtattccagagcgtacccatgaacttgcgctgtccctcctgcacgagtttgccgttaaaccgcttcggaatccacggcgcactgctcgtgtagaaataccagcggatcgcgtctgcaccgtaggcagagagcgcctcaaacgggtctaccgcatttcctttggatttgctcatcttctgtccgttctcgtcctgcacatgtcccatgacgataacattctcaaacggagccttgttaaataacagtgtactctccgccatcagggaatagaaccatccacgggtctgatccacaccctcggaaatgaatttggcagggaactgctgcgcaaacagatcctgattctcgaacggatagtgatgctgtgcaaacggcatcgcaccggaatcaaaccagcagtcgataacttccggcacacgcttcatggtcttgccgcagtccgggcaggtaaaggtcacttcatcgatatacggacggtgaagttcgacctccgcagccttcggatcgccgcttttctctgcaagctccgcgcggctgccgatggactcctgatgtccgcagccctcgcactcccagatatttaacggagttccccagtaacggttacgggaaataccccagtcctgaatattctcaagccagtcgccgaaacgtccttttccgatggattccggaatccagttgaccgtattgttgttgcggatcatatcgtccttcacagcggtcatcttgatgaaccaggactctctcgcatagtagatgagcggggtatcgcatctccagcagtgcggatactcatgctcgaacttcggcgcgtcgaaaagcttgccctgtgcctccagatccttcaacacctccgggtctgcttttttcacgaaaatgccggcatacggcgtctccttggtcagttcaccctttccgtctacaaactgcacgaacggcaggtcatattttctgccgacattcgcatcgtcctcaccaaatgcaggagcgatgtgaacgattccggtaccgtctgacatcgtaacgtaggtgtcgcaggtcacgaaaaatcccttcttgtgctgtctgtccgccacttcttttgcgcaggcgtacagcggctcatactccttgcgctcaagctcgcttcccttataggtctcaagcacctcgtaagcctttacctccggcgtatccggctcgccgtccttgcccttttcggctggtgttccaagccgtccgagcactttatcgagcagtgcctccgccatataataggtataaccgtcggctgcctttaccttgcagtaggtatcctccgggttcacgcagagtgccacgtttgacggaagtgtccacggcgtcgtggtccatgcgaggaagtaggcatcctctccaacaaccttgaaacgaaccacagcggaacgctccttgaccgtcttatatccctgcgccacctcctgtgaggaaagcggagttccacagcgcgggcagtacggaacaatcttaaagcccttgtacagaagcttcttgtcccagatctgctttaacgcccaccactcggactcgatgaaattgttgtcataggtaatatatgggttctccatatccgcccagaaaccgacgatgtcggagaaatcctcccacatgcccttgtactcccacacggattccttacattttttgatgaacggctcgattccgtactcctcaatctgttccttgccgtttaagccgagcatcttctccacaccaagctctaccggcagtccgtgcgtatcccaaccggctttacgcggcacatattttcccttcatcgcctgaaatctcgggatcatatccttgatcgtacgcgtctccacatgaccgatatgcggcttgccgttggccgtcggcggtccgtcatagaacgtgtaagtctcgccctgcttgcgctgctccatacttttcttgaagatgtcattgtctttccagaactctcttacctgcttttctctgtccacaaaattcaggttcgtgtctactttgttatacattttttcctccaaaataaaacatttaaggctcccgtcctgtaaataggacgagagcctttatcgttataccacctaattacattgtacacagacttctcccagcgcagaaatcctggaatgtcttcctgctgcctgaaaaatctccagtggagaaaatccgaatacccgttccctttaacgcaggaaaagcgtcagcgcctaccgtgctgccttcctgtctgacacaggctctgctgtgccacatctgcggctgcatttcgggctgcggcttggaagggatcttcgtctgcggcttactcgcaccggctctcaccgccccggctcgctttgcctttcatccacagcttactgtcttcgtcactgcctttgtcaactatgtgtaagtataagccttgcaagcccgcattgtcaaggtctgaaatgccgtttccctgccctccggttctgctccacttgcggtcttccgcttctgcttcacttgcgttcttccggctctgcttcacttgcgttcttccggctctgctccaattgctgccctccggctctgcagactctgcgtctgtgctatctccgctttgcaatcgtcgaaaaaaaacgctccttgatctggtcgatcaaaatgaccgccttaccgtccgaaccggtaaacggtacaaagccacctgccatcgcagcatgcccgccgccgtttccgatcccctgcagcgcctccgccgtgatcttgccggcgtcgagagaagatttttcactccggacggacagtttgatgccatcccctctccttgagtacaccacggaaaaagaaacctccaccagcgccagcataaagtcagagacactcgcgatcaatgcctccgggcagtcctcccccgtatcggcaaagctgatattatcgtacacctcaatgctggaaatcgccttggaatacgccaccagatcctcaaaacacaggttgctgttctccagtgtgtggatctcctcataatcacagtcatcgtacatccgatagagcatctcgatatcgagctttgacacgccgcgtgaaagattgtgcgtgtcaatgcggatgccgtatgtcagtgctgttgcgatctttttatccatcgcaatgtcattttccataaaatactgcgcgatcatcgttgcgcacgccccgacctcggggcggatgtcctgaaaccggtactgacacttatcattgtaaggatgatggtcgatgcagatgatctcatctcccgtaatattgatgatgttggaattgcccttctgggaatccaccagtatcacttcgtcctcatccgtcagcacttcggtcagatcctccacattcaacagttcaatgtcaagaatctcacacagacggccggtaccgtaccggtcgatcttgcccttatagcagatgctcgcctcgatacccctggttgcaagcagccgcttcagaccatatgcacttgcaatcgcatccggatccgggaaattatgggtctgtatatagacatgctgtctgttgatctgctgtagtaattcttcaaactttgtcatgctttctctctcctgcatgcggctgccggctcacatggttccggcgctctgttctctggctgcccggtgctgccggctcacatggtccaagcgctctgcgttttgctcgccgatgaaatatcaaaggtttttaggtctgcaaaggttttcagttccgggaccggctccgcaatctctccgaatccatatgcggcgtggataaacccgactcctgccgcccggctcgcatcataatctccttgaatgtctccgacatagaccgcctcatccagccggttccgctctacgaccagccggatattttctcccttctgccgcagattattgccataacactctatgtcctccaccagttcccacaaatcgtagtggtcaaggaatgcctcgatataccccttctggcagttgctgacaatcgaaagatgatagccgtcccgcttcaacgccgcgagcgtctgcggcacctgatcgtagagtatgcccccatgctcccgcagataatcattttccacctgacagcattcctttaggagcagtctccgtttttcttcggggaattccgcaaagaggatatcggcgattacgtccatcgtttttcccattaccccctgaatgtcctgcgttgtcagttctttctccctgaccccgtactgccggattgccacattccaggacttcgccacattctctgcggaatcccacagggttccgtccatgtcaaatatgattccacgtttcatgacatcatctcccgttctctctcttttgtctaggcttcctcggaaagtccatacagtctcgtgtattttttcttcatgtagcgcacgagcggctgcgcggacacttctttcccgcacactgccgcaattacctctttcggtgtccgcgtgcttccataccagtgaatcttctcattgagccattttgtgatctcaccgattctgccgtctgccaggatctcatccacggagccgagttcctcctccatcttctcgaggtacatgccgtcatagatgctgcccagcagataggacggaaaatacccaaacgagccgtccgaccaatgtacatcctgcaagatgccttcggcgtcattttccggagtgatatgcaagtattcctgcattttctgattccagagctccggaagtttttccaccggcacatgatcgtagaaaatcgctttttccatctcataacgcaatataatatggaagcaatacgttacctcatccgcctcggtgcgcaccatactgttctccacgcggttgatttcacgctcaaacgcttcgagtgtcacattcttaaactgtggaagcaattctcccagtttttcatagatcggcttccagaaattgatatttcttccgagaatattctcataaaagcgcgactggctctcatgcacccccatatagcagcagctgcccgccaccgtattgtcgtattccgggttgacattctgttcaaaaatcgcatgtccgccctcatgaatcgcagaaaacatggcgctgagcggctccgtctcatagtagtggttcgtcacacgcacatcctttgaagaaaaattcgtcgtaaacggatgctccgtctccccgaccgctcccgcatccctgcggaatccgatgtaatcaagcagcagccactgtaccctgcgctgtgcgtccggatcagcataggcatgaaatgtcggattttccggcattttctttgcagtaatctgctctactaacggtatcagttccgtcttcacttcctcaaacagccggtcgatcgttgcctgatccatgccctcctcacactgttccagaagtgcgtcatacacatcctttcccggatctgtatagccgattacctgcttcgtcatctcaatcatattccggaggtgcggtgcataaatggaaaagtccgatgcattttttgcttcttcccatgcatttccggattccgccgctgcccgcacaaacgcctcatataaatccgccggtattcttttattgcggtcgtaatcgcgcttcatgcgttttacaatgaatctccatgtgtcatctaacgcatcatattccgcaggctgcgccagtttctccagaaattctcccagtttctccgatgtccccatctcaaagctcttcgtggaaaaataggtcagcgcatccacatgcgccgcctgcccaagcttcggcactgtcgtctgcatatcccactgcaataatcctgtcacatgatcatactgattcatttcttttaaatattctttaaattcttctaataatctactcatcttatctcctgattttttctttattccgccggcataccgtcaatgatttatcgcggattccttctcctgaccgttgctttcccatacaccttcagccgctctttgacgcatactttccatgtctgcgggtcttaccctgcgaacctgccagcactcgttttgtcacgctgattttgagttccggcaaaagtccataaacagctgctttctgcacatccatatctcgacgatgctcttctgcacatccgatattccgtggaacttccgggaggcatccgctaggattcattttcccttgtttctgcactgctttctgtgcatccaatgttccgtggaacttccgggaggcatctgtcagcattcattttatcatatcttacatagactgtcacgaattatgtcgggtgacgaaaagccaggggagatgagactggcggggatggaaatctgatagaatcctgagcctcacaggtctgggagtatatttttttctctccagacccgtttttcttccttaagcgggtctgggcgcgtatttttctttccctagacccgttttccggacttgactgttcaaaatgattgacataatttcaatccccgggtctaattgcttgttttcacattccctagacctggttttcttccttgggcgggtctggaagcgtatttttctctccccagaccctgtttccgggcttgactatccaaaatggttgacataatttccatttcccgggtctagctgcttattttcacatctacagacccggtgtcgcacaaaaacatttcaaataagttaacataattccaactcatgggtctgagcgcaccttttctccactccagacccgcaaaacatctttagcactgtttctaaagcatatcccacaaaaatatagctttcttctaatattatagcttccttctaacccgcaaaaatgatacgataagagcgcaacccattgatttttctgacatttagcacaggtctgccgcactaccgcaccggcagccagaaaggcggttccattgaaacattttctccgattgaccgactataccaaagctgacatttacgaaatcttccatatcaccgatgagatcctggaggggcactatcagaatctgctgcagggcaaaagcgtcgttttatttttcccggaatccagcatccgcacaagggtcacgtttgagaagggcatcgcgcttttgggcggtcagccgattttgtttccaagttccgctctcgacaaaaaggaagatttgcaagacgtcatcggctacctcaacaactgggccaatctgcttgtcgtccgccaccgggatatggccgctttggaaaaaatcgctgcatctgcatccgtacctgtcatcaatgcgctgaccgacgcaaatcatccctgcgaaatggctgcagatctgtatgcgctctcaaaaatacggaatgattttaccatggaccactttctgttctgcggtgtcacaggaaatatcgggctggcttggaaggaagcctccgaagtgatgggcttttcgctggagcagtgctgtattccgggatatgagatgaatggcgtgccctcacatcactgcatccgcgacgccatccgtggaaaagacatcatctgcaccgactcactgccggccgaccttctttccgcctcccgcggctgcaccgtcgatcttgctgccatgaagctggcaaacgagggtgccatcttaaatccctgcccgcctttttaccgcggcgaggaagtctcaaacgacgtcatcgactccgactattttgtcggatatgaatttaaaaagcacctgctcaccgtccagcaggcaatcatggtgtactgcttaacacactaaacttttcatataatgcattaagcttttcattttttgacataacacaatatttcctgcaagaaagaatcctgttttgcaggattctccgcctgcggcgggttgctctagcgacataattccactccaacgcagtgcaatcctgcccggagaactttttcattcataggacgtaatttcctatgaatcaaaaaaactcccgtgcgcgtgatacctctcttttccacagcactctgtagaaaataccggcatcccacgaacggaagcttcctgtttctttctattctactttacctcgtcgatcgcacgtccgatgtcatggcgcatgtacttattcgcaaaatcaacccactctgtcgcctcgtatgcttttgcgcgcgcctcctttaaatcttttccggtcgccgtaatgccgagcacacgcccgccgttcgtgacgatcgtgccgttctcatcgaacttcgttccggcatggaagcagaaataatcgtcctttccgtcgaacttttcaagtcctgtgatcggaaatcccttctcataggacaccggataaccgtcggatgcaagcaccacacataccgccgcattgtcttcaaactgaaggtcgatcgtatccagctttccatcgacgcatgcctccatcacatcaatgatgtcattcttcatgcgtgggagcaccacctgtgcctccggatcaccaaaacgcgcattgtactcaagcaccttcggtccgtcctccgtcagcatcagaccgaagaaaataacgccggtaaacggtcttccctccgccgccatcgcatccacagtcgcctgatagatgtgcttttggcagaactcgtccacttcctttgtgtagaacgggctcggggaaaaattgcccatgccgccggtgttgagaccctgatcgccgtcctttgcacgcttgtgatcctgcgcagaggacataatcttgatcgtctttccgtccacgtaggaaagcaccgatacctcgcgtccggtcatgaactcctccacaaccatcgtgtttcccgcggagccgaacttcttgtcctccatgatctccttaacacccgcctttgcctcctcgagcgtattgcagatcaaaacaccctttccgagcgccagtccgtccgccttcaatacgatcggcatcttcaccgtctccagataagtaagcgcatcctctgcagatgtgaaattctcgtaggcagccgtcggaatgtgatattttttcatcagatccttggaaaatgccttggagccttcaaggatcgccgcattcttccgcggtccgaatacctttaagccctccgcctcaaacacatccacaattccgccaacgagcggatcatccatgccgacaattgtaaaatcaactgcatgctccttcgcgaacgccaccagtttgtcgaactccatcgctccgatcgcaacacactctgcaagcgatgcaattcctgcgtttcccggcgcacagtagatcttatccacgcgcgggctctttgccacactcgtcacgatcgcatgctcacgtccgccgcttccaactaccaataccttcatatccgcttcctcctgcactctgtaactcatacgcttatttctcaactgtcacatgtccgtttgcaacagacactctgccgtttgcaatcagatcgatcgcctgcggaagaatgatccactctgcctgctccatcacacggcgctgtaaaatctccggggtatctccctcttcgaccgccaccggcttctgcaaaatgatcggtcctgtatccgttccctcatccacaaaatgaaccgttgcacccgtaactttcacgccgcgcgcaagcgctccctcatgtactttcaagccgtaaaagcctttgccgcagaaagacgggatcagtgacggatgaatattgatgatccggttgcggtactgcgcgatcatctgctccggaattacaacgagaaatcctgccaacaccaccagatccacctgatagctgtcaagcatcgccagaaacgcttcattgaatgcctcacggctctcataatccttcggtgaaatgcaaagcgcctcaatgccgtgccctttcgcacgctccaacgcatacgcccctggattgttgctgatcacaacgtctacccgggcgttcgtgattctgccctcatcgatggcgtctaagattgcctgcagattcgtgccgcctccggacaccagtaccgctacttttagcataaggttactcctttttcaccatccttgatctcgccgacaatatacggtgtgtctcctgctgccttcattgccgcgatcgtcttgtccacgtccgccggatccactgccacgatcatgccgatacccatattgtaggtattgtacatcatctgctcctcgactttgccctcgcgcgccatcatctgaaagatcgccggaacttcatagctgtccttccggataaccgcatgctttccttccggaagcatacgcgggatattctcatagaaaccaccgcctgtgatatggctgcatgcttttacgcggacgcccgcttccttcacctcacggagtgccttcacgtaaattctggtcggagctaaaagcgcctcgccaagtgttttgccaagctcctcatgataggtatttaacgtatccgcatccatggagaaaatctttctcaccagagagaatccgttggaatgaacgccggagcttgccataccgatcaaaacatcgcccgccgcaagatcagctcccgtaataatgtccttttcatccacgataccaacggaaaaaccggccagatcgtactcattctccggcatcagccccggatgttctgccgtctcaccgccgatcaacgcacagcctgcctgcttgcagccctccgccacaccggacacgatcgtcgcaatcttctccggatagttcttgccacaggcaatatagtcaaggaaaaacagcggctcgccgccggcacatgcgatatcgtttacacacatggcaacacagtcaataccgatcgtgtcatgcttgtccagtaaaaatgccagttttaccttcgttccgcagccgtctgtgccggatactaacgtaggcttctccatattcttaaagctctccatggagaacgcaccggaaaatccgccaagtccgccaagcacctccgggcgcatggttcccttcacatactttttcatgagttctacagacttgtatcctgcctcgatatccacaccggaattcttgtaatccatcctattttcctcctatatgcttgtctgttgtctatccaacgcaacacgggcgactttttgcaaaatcatccgttcctgttcctagtaattctgatatcccacttcctgcagtctggcatccttcgcctgcacctgctcttttaattctttggaatattcttttaatttttgcaaaattgcatcatctgatgttgccagaatctttgctgcaagtaatcctgcatttgcaccaccgttgatcgccactgtggcaaccggaatgccggacggcatctgtacgatggagtacagggagtcgcgtccgccgagggacgtggtgtgcatcgggataccgatgaccggcatcgggaagatcgccgcgcacattcccggaagatgcgccgccatgcccgcgcctgcgataatgaccttaaagcccttcacctctgcgctctttgcatactcgaaaaatacatccggctcacggtgtgccgagataatcgtcatctcatagtcaattccaagcttctctaaaatgtcggcagcctttgccattaccggcatatcggaatcactgcccatcacaatacctacttttgccatattgctcctcatttctgcgcacattctgccataccgggttcgtgccgggtgcgccggggcacgaatcctgcgcgcggaaccgaatccttcccatgcgccagtttctcaatctgctcttagtatagcgtccacgcatttagaagtccaattaacactttttatgtgatttataaatacagctaatataagtatctatcccgcccggctcaccttcctacctgtccagcggtccgttcaacgcctccgttccggcaagcacaaaacgtccgtccgcgatgatatcctctgtcgtaccgtccttccggatcacagtgatcttatccagctcgtcgtacggaatcgtaatatcggtgtggcagtttaaatatgccttttccggattctcgcggcgctgcgccgataccgtattctcccgcgctacaatcgcttttccatccggattgtaagagaggttgtcctcctcatggctgtagcaggtgtcccccaccgcaaagtgcgggccggtcttctccgcaatcagaatcggcagtttgtccgcaatgtcatagtcgcgcgccatccggtatgccgtcgtgttcgtgccgattgcaaattctcccatcggcagcgtctcatggtgcatcagcacattgtcgcggatatagtttttgttctccgcctcatcctcgaaattggtgcaggtgtatttttccaccatgccgtccttaaaatcgatctccagattcttgtaattcagaccgttcagatatacctgtccgacatgcagctttccgttcgttccctcaagcaccggcgatgtaaacacctcgcccaccggaatattcacgtccgccacacagttctcaaatgcggtctccccttcgggattccgaagcttccagatgttgacatataagtcggtcttattggctccttttccggtgatgtgcacacggtccgcctgatcgagcacgtcgatcatcttctgctgcatgttgcggtagagcatgtaatccagcgtattgatcttcaccgtctccgcgaaaatctcctcaaagcgggcgccgatcgacggaagcgggtaggcaatgatcgtaaaactgcgctcctcccccttgatgtactggttcgtgatctgtccgcgctggctcatctcatacacacagagctgctgctgtttttcaccgtaacggaatgcctctttttttgtctccggagaaaaaggttcttctccgaacacctcaatcaccgccggccccgccatgccgttcgcatgtactttttcttcctcaaatgcgtttttccacgtctcgagtccgcgctccacgtacgccttgtcaagatagtacgcgcgatcctccctgtgatcgtagtcatactgcttgttggctgccgttcccgaagccagcatggtcacttcgagtcccattttttcaaaattgcacactgctgcacgcaccatacgctcgaagccaatcggataccgtacctgcgccgccgtctttttggacagatccttgcccgtcgtctcaaaaccgatccggtagccttccgtgtatgtgtccgccatcgcctggatatccgcctccggcagtgtatttaagtaagcggcaatctgtctctcattctccccgatataagcgccgtagcggtaaagataacgcagatccgacagatccgcctgcatcacgatctccttttcaaaatcctccgcaggattcacaagacgccgcaccgaccgctcgtcaaaaatctcccgataatcatgaaaataccagtacaaaatctgctgcacttctttttcctgcggcagggcatctgctgctgcgccttcaaagcagttgtagacctccacaaacagctccatcgcgatcgtaagctgcatcagatttccgcggaaaacctccccgcatgccgtccgaagatgtgccgcaagaagcgagagcgctccgccgaacgtctctcccagacgtgcagcggcgtaggccggattcgcatagctgtgcccgtaggcttccggcaggatctccccgtagagcgcctcattgtccgcctcacattcctccatgctccgcgccgcaagactgccgctttttcctttttcatacagtgcacgaaggctctgtaaatatccggcatttgtccggaaatactccgcaaacggctccggcgcctgcgccgcctctgcaatctctgcaatccgttccgctaccagttcatagcgctccgccgccagttcatttgtctccttgtaacattcctgatatcccaaatcaattcctcctcacaaacaataaatcccgcgccattgcgggatttgtattaccttatgaaaacgtcagccatgcctgaacacaaatccatccggattacggctgaagacgtcctttttttacattttcctcaatgagcgactttgcatacgcccacagttcctcggatccctcatgtgttctgctgttgcgcgcaagcacctgagactccctgacgccgtgctccacccaggatttgccgttcgaagcattgttcagaagaagcggctgtaccttgtccagcatattggcgaacttcgcctccaccgtctccatcgcctcaaactcatcccacagaccgcgatattccatgcgctgtgcatccggaagcagcccgaaaatacggtccgccgccttcaactcgcgctcccgcttggtcttattgccttcggtatcgtatgcgtaggtgtccccggcgtcgatctcaatcacatcgtgaagcagcaccatcttcatcgtctttagcacatcaatcttctcgttcgcataatctgcaaacacaaacgccatcaacgccagatgccaggaatgttccgcatcattttccttgcggcttccatccgacagataggtctgtcttgttatcttttttatcttatccagctccatgataaaagccatctgtttctcaaaatccgtcatattcttctcctatgccaaaaagccgatcacgtacagcgccacccagattccggtaatcagaagcgagcagagcgtcgaaagatacgggaacagcttaaaagagttctcctccccaaggctcttcaccgccagaacgagcgcacagatgccgatcagcatcgatgtcactcccgcacttcccagatacatgctcccgttgccgcggctgtcaaaagaactgaccaccgccgcaaccagtatcccgatggaaataatcgacaaaaaaagtgctgccacacccctctttgagtgtgtcttctctgtaaatctgtatccgtttctatgtcgtctcgccactttcttttcctctctgatttctctgatgataataacgcacaaacaggcgatataggccgtaacccgccataccgcccagcgtatttaacaggagatcgtccacatcaaagcttccgactcgaaagacaagctgcagcagttctaccagaagactcagttcaaaactgtaaaatgccgtccgccagaattttttacacctgcctgaaaaaacgggcagaaaaaatccaaacggcagaaacgccgccacatttcccaaaatattgagcagtacggctttcatgccgaggactctccagtattttacaaaacgcgcgatctcctttaacggaaccagattgtaatgatatgcccgctcgctgtaggtgcgccccatcttctccgaaaagaacagaaaataaaacagcaccacaaaataaatcagaaataaaattcctgctgcaagacgatgttttcttctagttgcagccatactgcttatagtagtcgtcaatggcagccttgatggtatcgtcaatcacaacacgtccctggcatgtgcggttgtacagatgctctaccacctcttccatggtaacgatcgcattcgtctcaaatccatacttttcgcggatctcctccaatgcgctcttctcgccgccaagccccttttccatgcggtttaaggataccatcagccccacgatcgtgacatctgccgctcctctcaccttcggaaccgtctcctccatggatttgcctgaagtcgtgacgtcctcaatcatgaccacacggtcaccgtcttttaacttactgccgaggaagcttcccttatctgccccgtgatccttctcctccttgcggtcagagcagtagcgcacctccttgccatacagattgtgaaacgccaccgcagtcacaacgctgatcggaattcccttgtatgccggtccaaacagcacatcaaaatcatccccataggtctcatgaatcgctctggcataatactcgcccagacgcatcagctgggatccggtcacataagcccccgcattcataaaaaacggggatttcctgccgctttttaaggtaaactccccgaacttgagcacatcgctctccaccataaattcaataaactcctgcttgtactgctccattctatctatatcctcctgttatcctaagccgtcttttgttttcgttctattctactctaccataaaaaaaggagaaccgcaatgcgtcccggtagctttcggccttcctgttggcgtaaaaatattagcagactccatcataatgtgtccacattctaattattttcacggttccatcatacctcatccctttccattccactggctcactatacacctgataaaccagcctgtgctgaatattgattcttcgcgaataaactccctgcaaatttccaaccagcgcttcatagggtggtggattttgaaaaggggtttcccggatgacctctatcagctttttcgccttatcatcaagtctggcactcttcaaattcttaatatcttttactgcctgcttatcatatacaattctgtacatagatctaccattctacatcttcctctggcacacaatcttctaaccgcgtatccatcccgcttcttatggattcaaccatacctggaattgcgttcaaatatatcgtttcctgaattgcattccaatcattctcggaaacaagaaccgcatttccttttttgcttacaattaaagccggttcgctgtagcgattaacgtcttctaccagactgtagagttcctttcttgcatttgttatattgattgccgacataataaatctcccttttgcttgtagtgtaatttctatatttttttgttattttgtcatttgaaaatctcttgttccattctcgtacattcttgttcttcattttagttacatcaaatccgatgtagttgccttatgttcttttatgcttatgaatgtcgagatttttatgtcatagttattatagcgtacgtcattgcgtacgtcaagttgctattttattctatgcacaagtcacacaaatttttcccataagcaaataaaatatccagaatcccaaagtcagacttgtcttttccaactccggtttctggatatcttctgttcctccgatatacgcttataacttctccgcttctcttccgtatacttcaatctgcgtcagcgcagggaacggcgacgggtcgtccgcttttttcagcttttccaaggtcagttctgtgataacccgctcctcgaatacgatctcgtgcggcttttcgcttttttccagctctgccacgacctcgcttccatccgagaaccggatcgtcacctgcttccaccagttatcgtgcgggaaatccgcccttgtgtacagacggatgcggctgaccaccacctttctgccgaattccagcctcatattcgcatcctcgcgtcggttgattccccacgattcatacggccattctccgtgcgcatcattcaccgtgacgccgtcgatcgcgtttctggcggcgaacaccgcctccccgcgcgtctccacattcgccgatgcatgcggataacagttggtctccccatgctggtccatcacattttttgcaagattcctgcaggagccgaagcatgtcatatccgcaagctttgcggtgattaaatgccggttcccggaaaatgtcttgggcgagtaggaaatctttctctccccgaacggaatcctgtagtggacgtccccggtcacatagacggttgccgccccgagcgcatcgtccgccatcagttcgtagaaggcatttttcggggagatctcaaagataatctcatccccctcctcgtattctttcgtgtagaccagtgccgcctcatcctctcctctggcaacacttagggtcatgccgtccttattctgtatcttaatcgttatcactgccatctttcccctcatctctccattcatactgtgaaaaaacaaacgtcaggatcttcgcgtgtacatatgcgattccgccggccgacacaaaaagcagcggccagaacacaaacaacgccgccgtgataaacagtgccgcggatgtcagcatcagaaatgtccagccgaagttcttaaacgacatcacaaacgcaagcgcaagcgtcttctttaaatccgcgtccgtccatgccagcagtggaaacacatacagggcaacgaagacaaaaatcaccgacagcaccagaaaaatccagaaaaacaccgttccgacgccgcctgcgaggtgataataaaaatataaatccgctccgaaaaagattccgagcgccagcattccgatccaggcgatcgtcgcagatttaaaattctccttaaacgcccgcacaaaatcttcccggatgtagccctccttgttggacgctaacgtcatggaacaatagcagagtgcgcacgtcgacgccccgattgttacgaccggcagtgaaaaaagcagccacagacatgtcagaaaaaacatatccgtcacctttcccataaaacgccagaccggattgtccatatcaaacatttttcccatcgtctttcctccctgtctcttcctgcgaaatcatcgctttgtattcctctgccgaaaacgcggctgccaccccggtgttctcctcaaagatccaccggagcatcccgaccgcctgctccttcctctctgatccgctcacaatcccgatcaccgggtctaagagcgtaatcccgtactgcttcacaaacgcggtatctgtcagtgtgatgccgcatgccacaccgtttttttcatagatgcgcgcccccagcgcttcacatgccccagcgcccagcagttccccaagatcagcaaacgcattcaggttacagtaatagtcaaacacatctttttccagaatcatgaagtcgagctcgtgcgcatacacgtacgtcgtgatcgttgcgagggaatcctgcgtattggcatcggcgatcggcgtctgccccagcgcggctgcatccatggtaagcgctgtgtccacgacgacctcctccccgttaggatcgcccccgatcccggcgaggatcgcctcctccatctgggttgtcaccgcatcgtcctgcacattgttgaccacttctcccatgagaatctgtgtcttttcttttttccccatggtgtccgcaacatagaggaccgctgccgcgagaaccactgcaaaaattacgacacctttataataagtccaccaatgctccagtttctttcgcaccgcgcatcctcctttttgcttctctcctaccagttcagaacgtcgcccaccagcacatcctcggccttgtcaaagacaatcacatttccgtagcccatacagccgtctgcctccacgaggtcggtcggcgaattgacctcctgatggcagaggatcaccacatattccttttcgcctgtggtgatctttaatgcctccgccatcgtctccggatagtctgtctgctttaatgccgagcgcaccggaagcttctcaatcgaaagcgggcgtcccggatgtgcatcgatgaccgtgataaggctggtaaaaccgtcccccggctttgtcaccttacacaccgtattttcctcttccacattgtaatgtcttgcaatgtggccgcgcttaagctctgctttcacctgcgccgacacaaaataaaaatccgcttctgccattttaccacgataggccacgcatgggaacttcttttctcccggcgcagtcaacgtcaccgcaccatgattgttaaaatgaaaatactgctggtaggtgtgacagtccccggtgtacatctcatccaccagaatatacaggtcaggctttatgtaaaccaccttccggttcacatagacgccgcccggaagatccatgtagccgagctgccccgcctgtgcaaattccgccagctttgtgcaccggaaattctctttgaccggctgggaaagcttcgagcactcccaggaatccttgcagacggtaaacggcagatcatccaccgtgatcgtattgtgtcctgacggatccttgtacgaaaaacgctttggtcctgaaacgtaggtatatctaccaccgtccatcagcacatcctcgccgtttacaaccaggtcgatgtgcagcttatcggaatgtccgtgccccgctcccatcgtcccggaatgcagatgcaggaaattggcgcgttctgaccagtccgaccggaaataagtgttcccgctgtgttccagaaacagcgatgtaaagtccggttttctgcgctccatcaccgcatattcttccccggctttcatgccgagatcccagatactttcataatcaagacggtcgaatccgccaaaccgcagcaccggatttaaaaacagatacgccgccacgctgatgcggtcccgcacatccacgtcgtcgctgtcccccatcatcacgatgtggtgatccggctttaaccacgcgacatccgccattgccatcttctccgtctggcgcaggatcacgtccggcagtgcaatgccgttccgctttgccagaaggatcacgtctaacaggcagtgcagcacctcgttgtgatacatcggcgactgctcccagtgcacgccgtccggcatgatctgcatccgcacctgcacctcaagattcttcacggcaaacgcgataaactgctttgtcttctcgctctgcgggagacacacgccgatctcaaacagcccgtgattctcaatgacgccccagttactcatatagcggtaagcggaatgacattccatgatgtgttccgcctgcaggatcatgctgtcataatatttctgtaaaaacgcttccgtgagcgtcgggctgtcatgaaacagccagatcgccttgctccagtattccccgcgaaagccggtgtctagacttctccacggtcccgccgcatacttctcgttcagcgggacatgatcgatccagtcctccgcaatctccataaacgctctcgcatatttctcatccccggtcatctgatacgcctgaccgagcgtcatgaaaaagcggtgtctgttgaactgccagacaaattccggatcgtctgccggcatatacgtccagtcgatcgctccgtcaaactgtaccggctcgtcggtctgctccagatcccacttggagttgaacagaaaatatttccggcacacaccgtccgccaccgcaagcgtctgcgcgacatcttctggaaattgctccctgcagtacgccccgaccgcttttccatcctcacagtaatagtgtgatgcatccctgtcaaaaaatgcttctcttttcatcctgccataccttcctttttcccttgttaccaatacggattccagtcttttttcagccgcatgagcgcttccatgtaaaaatagtctccccagatattgcactcgtccaccccgtaatgattgcaggtattatacggagagtggttggaataggtgctgtgtaacaccaacccgttcgactcttttggatctttcaccgcgtatccgtcgtacaacgccttcatcaaccgttttgccgttgcacggtaagcttctgcctcgtccggctttagatattttgccatctcaagcattccgcatgctgcgatcgacgccgaggaggaatctctcggctgatcgtccccgtccgtgaactccagatcccagaacggcaccatatccttgggcagatgcgccaggaaaaagtccgtgacatcccggaacttctgaatgtattcttccctttccgtgtacttgtaggcgagcgccatcccgtagatgccccatgcctggcctctcgcccacgccgaaccgtcgcggtatccctgacaggtggctccgtgatccggtgcccccgtcttcatatcgaagaaaaaggtgtgccaggtggaatgatcctcacggatcacattggcgaccgccgtgtgaatatgcttctccgcaatgtcccgatacttcggatcgccggtctcctccgacgcccagtagagcagcggcagatttaaaagacagtcgatgatcagccggtagttttccggtgcatccatcgcaccccacgcctgtataaaattgcccaccgggtgaaatctgcggatgagctgatcggctgccagtatggctgcctttcttcccgtctcattcccggtcagtttatagcccgccacgcaggacggcgaatacaaaaatcccatatcgtggtgatcgacttcgatcttgttttcaatgcggttcaaaaagctgtcaatctggatttcaccggcttttttatagatgtctttcccggtatcctcgtaggacagccagatctcgcccgtccagaatcccgtcgtccagtccacattgtccgtcggcgcgtaaaacccgttctcgctgtaagccttctggaacttcgtcgtgaactccggcagattgcgctttacctgcgccgtggagaaatccatcgcctctctgatctcctgctctgtgatctgcggtttttcttcgtatcgcatacccttcttctccttttccgttttcaaatcatgttatgtttatccaacacgttattcctgtagagtaaaacaaagccgtcacacaaacgatctctttttgtgtgacagctttgttacataccttcggtcttagccctttaaaccggtagatgcaattccctctacaaagtatctctgcagacagataaatacgatgagtaccggaatcagggaaagtaccgagcctgccataatcagtccgtactgggaggaatactgaccgatgaacattttgagacctaactgaatggtcttcttctcctgggattttaagtaaatcaatggtccgaggtagtcattccacgttgccacgaaagtgaagattgtcagcgtggacagcgccggttttgacagcggaagcatgatgtgcgaataaattttgtattcactcatgccgtcgactctcgccgcctcacacagttcgttcggaataccgtcatagaactgtctcatcatgaacacgccgaatgcggaaaatgcctgcagacagatcattgcgagcagcttatcgttcaatcccatcttacgcatcatgataaactgcggaaccatgtatacctgccacggcatagcgatggtcgcaatgtatgccatgaacagtacattcttatgcttgaactccagttttgcaaaagagtatgctgcaaagctgcttgtcaaaagctgtaaggcggtcaccacgattgtgaggaacacggtgttcttcacgaacgtgccaaacggaatcttcgtccagatatccacgtaattgctccagcgcggtgtctccggaatcagaacaaacggcgtcatctggaatacttcacggtctgtcttaatggaagcggacagcatccagataaacgggatcaacattgccgccgtgataatcagtaaaatcagatacaggaagaacttcttgatcagattgtttcgtttcatcgatgtttcttttttctgctttgtcattatctctctcatctctgttctccccctttctagtcctctaacttcttctcatatgcaaactgtataatcgttacagcaagtaccagtacaaacagtaccattgcgaccgcactcgcataaccgagtttccagtagtcgaatgcattttcgtaaatgtagtaaacaagtacggatgcggagttgcttaacttgccctggcttccgcctgccagcatgatggcgatgtcgtacaccttaaagcagttgatcgtcagcatcacgacaacgaaaaaggtggtggatcgcagctgcggccaggtgatatatttaaatttctgccaggtcgtcgccccgtcgaggcttcccgcctcgtataattccgacgagattccctgcagtcccgcaaggtagattaccatgtagtaacccatatatttccagacactgaataaaataagtgtcagcataatcagatttccgctaaaccagttcggcagattcttctgctcgatcccgcagattgtcatcaaaagataattcaccggtcccttggtcggatgaaaaatcatggaccataccgttgtgatggcaacgagggatgctacatacgggaagaacgataccgttctaaaaaaacctcttcccttcaccttctggtttaagacaattgccagtgccagcgacacaaccatggtaagcggtaccgtgccgacacagtagataatcgtgttttttaaggatgccgtgaaaaaagtatccgacggcagtttcaagaaattggaaagtccgacaaactgaatcgggttgtttccatcccattccgtaaatgccagaataaaggcaaatatgatcgggatcaatgtaaatacggcgaatccgatgaagttcggcgcaatgaaagaataggcaaccagatcgtctctggtctgctttgacagtttgcggccgcttcgcattgcagcagccttccactgcagtttgtttctgttttgaatcagtttctgttttttcttgttatcagtttcgttctgactttgttcccacagtcttgccatttcggcttccatctgctctaattttgctgctttcttcttatccataaccatgcccaaaagccagatacggcttatttcctttctcctttaagctgtttcatttttaagggccggctgttttcagccagcccttttatcagcagtcgtggttatgcttccgttccattactggttcagaatctttccaacctgctcattcatggatgctacaccctcttctacggtcacttcacggttcatgatggaagtgtggtaggtgtcgaggatactgttgatctctgatacgttctcagcatacggtacctcaaggtatgcatttgtgatatttaatgcttccttgctgccctcgtctgtcgggaatcctgccatgccggcgattgtgttgatgacatcgtccgtcataattgccgggaagttaccggtggaagccattacctttgcgccctctgtaccggatacccagtttacgaaatcaaatgctgcgtccttgtttgcggaagcgcttgtcactgcaagacctgtgatcgtagcgatcgtgctgcctgcctctgctccgtccggatgcggatagcttgcgataccccagttgccgcagagagagctgtcgtactcaccgctgtcaagattggagatcaatgtggagatgaaccaggaacccatgttcatcatagcaacatttccgttggagaatgctgcggagtagtgaagaccttctgtgcttaagtctgtgtaggtctggcatacaccgtcatcctcttcacttaagatcatgtcatagtacggaatcatccagtcgtaattgccgtccaggatagagtgttttccatccaggattccgaacagttcgactgcggatctccatgtgtgataatggcatccgtatacctgggaaccgtaggtggtatctgtcagctgtcttgccagtgcatcgtaatcttccatcgtcatatcgttggacggataagcaatgcctgctgcatcaaatacatctttgttgtagtagatcagccagtaatcgcttctgaacggaagttcatataagcttccatctactgttacctgatctgtgattccgttgaagtctgcgaggttaattcctgcatctgtgatgtaatcatccagggactccagcgtgttcttctgaaccagcgttgcgtaacccggtacatccttgatcgtaaccacatcgaagtccgatccgcttccggataactccgttgcaaggacagtcatgtaatcggttgatccaaggtctaccatctcaatggtgacgtttggatttgcagcctcatatgcctccttgagtgcgttccagtaaggagtggtctcctgatcccagattgcccatttgagagtgactgcctctccatctgtcgcagccgcatctgctgctgtctcagtgcctgccgcagcggtgtttgtgtctgctgccgcatctgctgatgcatccgttgaagctgtttccccagagccacaacctgcaagtaacgcccctgtcatgcttgctacaagaagcatgctcaatactctttttttcatctgaatcctccttttcgtatctctatcgttctccgataagatgattttattatattggctttgccatacaatggacatagatttttttacgtttaaattcacatttttttcctctttctgttttcgtctgcattttttcttcccaaacctgtcttttttctcaaaacctgtctttttttcttcactttgcttttcgctctcccaaaatggatttttttctttccgaattttctttttgtgtctataatataaggtatgaagaaaaaatttacgacgattcgatcccgaattacactgactacgattacactctgtattttcttaagtatcgctgtgtcctatatcagctattctttctattataaaagtgtaaaacaaaatatgatccgcaccgcggagtcctctctgacactgctcggctcctccattgacagcaacatccaggatgcttattctttcgtccgcaactgtcaggcgaactcttttatcctgaattatctgtcgtcacagggttcccagagtgcgcgtatcaccgcctctacttatctgaagggaagctacaacagttacgatggccgctactatatcaagcgcatttttattgcctcctacaagaaccgggattttatccaggctcttgcttccaccaacaaccagcccttccactcggcagatgatatccgggatctctatttttttgacagctactacagcagcccttcctattcttatagcgaaggtatcctgacaaccgacggcggttcacagtatcttccgatcatccggccgctttacagccagtataattccgacgagctcggttttatctacatcgaaatgtcgccgaacgtcgtcaccataccgcttaagaccgccggaacctaccagaacaacgacttttacctgacgttggaagatcacagctatgtgtacagcaattacaccctgacggacgccaacccttcctatgagattacgggagatctctcctccattgcatctttctccgatacgatcgtaaaggagatttcaaatgccaacggaaagttcgtctccatctcggttccgctcgccgcggaacactgctatatcacgcagctgatcacggtcaatacgttttacggacagcttgcatccatcattttcgtcatcgtggcgtgcgccgtcattaccggtatcattcttcacacgatttttaatcatatgatcaatcatccggtacaggaactgcaggtccgaatgaagcacatttccgagggaaatttcgagcgcgactcctcgatcgagtggcagcatgagctcggcgacatcggcagaagcatcaacgatctcgccgaagatgtgaaaacactgatggatcaacggatccgcgatgaaaatgagaagcgtgagtacgagtacaaaatgctgcagagccagatcaatccgcattttctctacaacacgctcaattccatcaaatggatggcaacgatccagaatgcgcctggcatcgcggagatgacgacggcactctccagacttttaaaaaacatcgcaaagggaacagagaaggcggttccgctctctgcagaactctcccttctggatgattattttacgattcagaaataccgttatggaggaaccatctccttagaatacaggatcgatgacgaggcggcattaagctgtctgattccgcgcttcaccttacagccggtcgtggaaaattctatctttcatggcattgagccaaagggaacacccggaacgatcactattcacattttccggaaaaatgacgcgattcttcagatcgacattaccgacgacggcgtcggcatgacggaagaacaggcaagacagcttttgtccgagaacaagaacgaaaagactgaatttttcagggaaatcggcgtcagcaacgtgcacaagcggctgcagtatgaattcggcgaagattacggcctgcgtgtggaaagccggctttccgaatttaccactgtgtccgtcctgcttccgtttgcgccgcaggaagacatcggctaaatgcagacagatatttttacaacaaagaaatggggttacagttatggtacagcttcttatcgtggatgacgaaccgctggttcagatcggcatccgctccatgttaaactgggagagcatgggaattgaaattgcaggcactgccacaaacggcaggcaggcatatgatatcattctggaaaagcatccggaaattgtaattacagacatcaaaatgccgattatggacggcatgcagctgatcgagaaatgtcagtcccaagagcatccgcctctttttattctcttaaccagctatgaggaatttgctctggtaaaacaggcgatctcctaccaggtgctggattatctggtaaagctcgagctgacggaagatgtgttaaacgctgccatccagaaggctctcggcattctggaaaaagagagaaaacaggcagccatcccggaaaccggttccgatctctccttattgcaggataatttttatatccggctgcttctaaatctattcgagacagaggaacaatttgcgacacagtgcgatcttctgtccgtccgcttcactgccgccggctacacggtggcgtatctggaaatgcagaataccaggcagagtgcgtccgctgtcgcatcgtcggacatcacactctaccgcagcagctaccagatgatccggaatctgatcgtcaaatatgtgccatgccggattctgttccttgacacgacacaccttgcgattattttttccctgaccaaagaacagacgggcagctatcatcagcttctgaccgatgcactcacacagacaggcgacatgctctacaattattacagcataaggattcttgcatcggtcggctctctcgtcgaaaatccgagagatctgtccgcctcctattcggacgccagacagattttcccggacgtccgccagagtgattctgccgttatctttgccgacgagggcaatcccgcccgcgaggagcacaacgtcttcaacattgccatctttaaggatgagctgcagaaagcgttcaacgaatacgatccggaagcactctccgcagtcttccacgacatcattgacctgttttccaatgataagagacattactcccaggccttatccgccgcgagcaacgtgctgcacttaaccctctcctgcctgagcaacggggaagaacagttaaaccagatctttggtgaatccgccaacgggtacaactgcctctacgaggcggaaacggtgccgcaggtgctctcctggatgaccgtgctgtgcgacggtctgtgccgcctgttttccgagcacaacaaggattacaagaaccgcaccatctccgcggtcaaaaaatatatcaatgaacacgttgacgagaagattacgttgaatcagctctccgatgtcttcaacatcagcccgaattatctgtcgatcctgttttccaagtacaacgatatgggatttatagattacgtaaaccacgcaaagattgaatgtgccaaggaaatgctggatgagggaacgctcaagatctatgagatctccgacaaactggggtacgagagcgcgttctatttcagccgggtattcaaaaaggtggagggcgtgtcgccgcgcgactatatcaaccggacttgaggcacttctttcttttgcccgtgttaaatgttataccatttaatctcgtttgcctccatctccagaggaaaactgctgccatcaccacgataaaccacagttttctggtgggcatatgtattgttgaccacgcagaacctgccatttttcacataggcatgtacttccacattgaagttggaactgaaccactgatgcagatccttctctccgtgggtactccacagaatactgcggtacagaatacggctgttctcaaagctgtaaggcagaccgctgatataaacacagcgcccctttccaaactcatggacagccatctgcacttccttctcccgctgtaccagaatttccgtgtcctcgtaagcgaagatgttctttttaccctcaccaaagtccactggcttcgtggtatctgccagaatgaagtgatcgggatgctcctcccagttatatttatcgtagtttaaagtaaatccggtttctttttccacgccgagcatatctgcaagctgcaggtaatgcccctgaaactgatgaccagacggctcaccgacaccgataaaacctccgccgttatatacaaactcacggatagctgcggaaatggcaggattctcccagatgccgccaccggtatgagcagtatccccatctcccacattgataatcacatccagatctttaagaatttccggatttgccagaatatcatcaaaggaaataaatcgcacatcgaaaggggcaccacttaatgcttcaataattcccgcatagctgtaattctgtttctggtatagggcatggtgtaccatatggcatccccagcttctaattttaccccagctgttcaacacagctactttcctcacgcaataaggaatcgttccctttgcgttctcatacagctcgcggaactcgttgcacacattctctacataatccagaaattccggaaaatccagggtcagcttcagatatccaccatagccgatccggtcaataggttttctcagaatggcacgtcttgcggtaatccagttctcctttgcctccttcaccgggtctccgccgtcacaaaaagtatcggggaaaaagtacggtaaaaatcttccctccgtgtattttacaccttcaatatcggagatgagacgaagggtactaccgtttcctacactgcctaccaccgcatcaagtccaatggtggcaaattcctccataaacggctcggttccaatccagtgatccccaagaaacatcattgcctctttgccgtactcatgggtaatgtctaccatctctttggcaattttggcaacctccctgcgctggaatgcctggaaatctttgaactccctgctaggcacacggtactggttgttgtaataaccctggtcaatgatgtactcaggccggaacctgtaaccggcctccttttcaaactgctctaagatataagggctgacagaggcagaatagccataccagtccacatatttttctctctttaactcatcaaacatcaaggtaaactgatggaaaaaggttgtgtagcgaatcacattcacgtagggatgatccgcgcagtatttgcgaagacgctccagggaatatttgtgggtcttaggctgtctcacatcaaatgtaatctgatgttcaaagtttttccagtcgttggtaaccgcattgtacatatgtactggatcccagataatgtaagccagaaagctgaccgtgtattcatggaaaggaatggcatcatgaatgaccacgcagcccttttcctcctcatattcccaatgatctgcggacacaacattaccggtagaacggtcgacaacctcccaccaccgttctttgtcgtctctggtattgaccatcatcagttcctgggatatacctttcataaggggaatctccaagtcagtatccacagcagtgtaaaaggatgtcatcacatagcactgctgtacttcatccgggtttgcctttgcccactcgttgtccttccgggtagtataataggtggcataaatttttgccccggttctgaccagttcctctgggaactctgtaccgtcgcagtcacgaatggcatcagcaccccagcgtttcatcaattctatggtttccggcaccacatccaggttggtaggaatggttacacgtccctcttttaaagtcattggtctcttttcctcctgcaaaagttaagtcgttgtaacagcggtttacaacggaataatcgtattatcctcctcggtataagttccaccgcccatcttgttacggacaaaaggcacaccctccctcacataaaaagtgttatgggcgagcaaagcatccgggttctccgacgggcttaccgtgccccccagatcgtcatagctcacattatggcaaaaactgttgtgaattgcttctgactggcagaacataatgcatccgccctcgttttgtctgctgtaattgtattcgtaaatggttccatcaccagaatccgcatcgtaagccatcccgtcctgatttaatcttgtatctgccacttcattgcagcggaacagggcatccttgcacttccatggccagatgcctgctgccacttttccggcacggttctccggccggcagtaaatcctgtcattgatttcgcatgcaacggaatctgctgtattgtgttctactaatgggcgcaaagcatacatcgcagtgatgccatcgcccccagcggcttttacataattgtcccggatgaccatattttcatgtccgtatttcaaaaaggtatcctcgggcagttccgccccctggaatttgtcatgtgcataggtgtatccaacagcgattccccaacggcttgtcttgtatacaaagcagccttccacagtgatatctttaaagcgcgccacaccggtagctttttcatcggcaggctttaaagctgtcatataaatgccgccgttgttcatatgtttgtcatagacattgccattcacatcatggatagaaaggttgcgcagggtaatgccgctgcgcactcccttatcctttgccaccacagccacgccagtgcggttcattttatgaggagcactgtaatcttcccccaggatttccactgcctgattgctaatctcaatatcatggatgaccacatgctctacatcatataaaagtacggcagaggatacataaccttgataaacatgcgcaggtgaatccaatgttgtaccgtaatcctgataccagatgccctgtcccccggctgcaatcaggggcttttttccctcctcctcttcttccggtgaataagagccaatttcaatgggatgctccctggttccactgtcttttatctgcagaaactgatctgtaaaaacggaatcccgggccagcagcaccttatcgccagggtacagtctcaatctgtttacctgaaaaaggctggcaaacggggaatccatggtcagtccgtcgttactatcacgcccggttttctgattgacataatatgtcctgtatgagcctgtcataggcatcctccctcagtcttttttcgataatctgccggacatcctcatagtcaaacaaatctccatggtaacgcccgaacaaatcctggttattttcataaaatgcccgcttttcttcctccgtaaaaccgggacagacacccagcttttttatctgctccgagggctgaacgaaatccagcttaaatcgtgtgagttcgtactgaagatacatggctggagaataaaaacggacaccataaagagaattttccttatttttctttgcccgccttttttccaaagcctcgataccggcatcttcaatgagcccgaactgttttgcaagaagaagggctgcctgcgcctcctcccattcttttttatccagacaatatttccgattcattatttcactgctcctgcaattccattggcaaaactcttttgtaagcacagaaagataattgcggtaggaagggtacaaatcaatacccccagcattaacataccatagtctacgctgtaaccactttttaagtttgcaaccaacatgggcatggtaatctggttgctgtcctgtaaaataatcgttggccagagatagttattccaggcattcatgaaagttactgtcatggctgcgccgtaggtagacttcataattggcaggaacatggtaaaaaaaatcctgatctcactaagtccttccagacgggctgcctggataatatcatgagggaaagaacgggctgcctgccggaacatcataatgagaaatggtgtagaaagagaaggcagtgccagtgcaatccaggtattaaccagcttccatgaagaaaacattttaaacaaaggaatcataatagcaacaaagggaagcatcatggcaagaagcagaatgttcatcagaaggtctttgcccttgtcatgataaatctcaaagccatagcctgcgatggagcagattaacagtgcaatcacagtaatcacaattgcattgcggaaagagttaaacatggctcgtcccagattctggtttgcaatgagactctggtaattttccatcagataaacacctgggaacagttttccacggacaatatcaatgctggagttggttgctccacaaatcatatagtacaggggaaacgctgacaggaaactggcaatgattaaaataatataagcgatagttgtctttactttagtcacgtttgtcacctactttcatctggattgcagaaagaactgccacactcacaaggataaatacggaaattgctgccgcatagttaaatttgggtgtttccacaaaggagatattataaacataatgcgccagtgtcatggtggacttaccaggacctccggaagtcaggttaacagactcatcaaacaactgtagcgtacctgaagttgacataatagccgtcaacaggatggtaggcctcaataagggaatggtaatcttcataaactgctgaaaaggggtcgctccatcaatataacttgcttcgtatacggaatcatcaatattctgtaagcccgcaagatagaaaaccatattgtatccggtccatctccagatcagtgcaatgatgatgacaaaacgggctgcccatgcattctggaaccagtccactctgtcaaagccaagggtcgtaataatattatttaccagaccgtcctgggcaaataaggatttgaaaatcatggaataggataccagtgatgtcgcacatggaagaaagataagagtacggaaaatactctttcctttaatcttcggactgttcaaaagctgtgccagccccagtgccagaagtaacatgacaggcacctggattataaagtaaaatacagtgttaaacagacactgctggaacgtcttatcctttaatattctctggtaatttgccagccctgcaaatcctgatccttttttggtaaaggacaggataattgcctgtatcataggataaaagcaaaagataaagataagaagtgcagccggaattaaaaatgcccatccggtcaggttatgttttttttccaaactcatttttgctttcttctgtttcatataaattctcctgattaaaaagaatatcgtttcgcgatattctgcgccgcttttacgccgctttgggcgacatatatttctgtaaaaacctgtgcatcctcgcctgtgaaaaaataccgggaacgcaatacgctgatcccggtactggctcatttttcacttacttattcactaatgttaaattcaacagcatcctgtgcattctgaatttcttcatcaatatcagcaccattctgtactacgttagtgattgcatcggtcagtgcacttctaatatcattataatatgcaccatagttaattgcgggaactttgcctgcaaactcaacaatgtctttgtataccgcctgtccaccatagaaatcagaagtctgattgtaaacatccgactgtgctgcaggcagatagctggaaattgcgccggcgttagggagtaaatcatcgtataattcaacgctgccaccaaaggttgtctttaggaaatcaaatgccagttcagtgttcttgcaattagaagatactgcccagcttgcaccaccacagtttgcgtaattggtggcaccatcaatgccgtctaaagcaggcatgtttacaatagcccacttaccagactggtcttctgccgactgaatggatgacataatccagcagccctggataacaccagcagcctcacccttgttcatggatgcaatgtactgatcccagtcggtgtagtcaaccataatcccctcatcgattaactgcttgtaaacctcgattgcttttttcaaagctgcgttgtccgccagatgaacttcaccattaacgataggagatgcgcctgcagactgcagcatctcgataacaatttcagaaccgccggaacttgtcagcatgggaacaccgtttgcatcgacaacttttttcgccagctccatgaactcagaccaggttgtgtccttgaaatcttcaacggtaagaccggcagcctctaccatatcggaacggattgccataatagatgctccattatcaaaaggaataccgtagtgttttccttctgcggtagaatctcctaatttaccaccggagaaatcgtcaaaattaataccggaatctgataattctgtgaaaacctcgggataatttgcaatatttttctggaaagaattatcctgcatcaggaaaatgtccggcagtgtgtcataattatcggcctcagcagcggtaatgatgttctgctcaatatcggtgtaaaccttctcctgaatgtccagtttaaaattgggatgatctttctggtaaattgcctcagcctgtttcattgcatatacattgaaggttggatcccagcaccatacagtaagaacttcttcgccatctgctgcatctgtgccttcagcttctgttgcagactctgccgggctggtttcagctgcaccgccggatgcagaagtgcctgctgtgctgttactgcttccgcagcctgcaagtgtggaagcggtcatcgctgctataagcagtgtgcctactaatttctttctcatattaaatcctcctttgaaacaatacatcatttgttgatggtttcattatagctttccatatcctactattcaatttctatgttgtcctattctatcaatatcttgctgtttttactaaaaatatgagtattttgacaaccttttcattttcagcattattattttccgtcattttaacgtagtattttttattacaccgattttaatatgcaaaatgacgattcactacttttatgttatattatattgttcagcaagatattgatattcagcaacaatttaacacaatacaccgctgtcttttcgtgatataatgaatcctgacggattcatatttagaagttcctacgtaacttcagatgcgcagaaggcagcgcagaaacaacgcaaaaatgatattcatgaaaataagtttttggggaggtttttatgggaaatgaacgtttcgacatctccattccaaaagaatatttaacaagagataaagcaagacttttatatgtttcctctgcaacctacggtggtgactggatcagtacgccccacacccattactgttctgagcttttctatgtaattgacggtgtgggacaattccaggtagaagacaatatcttcccggtttctgccaatgatctggtggtcatcaatcccaatgtgtcccacacggaacttggtttcaatgccaatccattaaaatatatcgttttgggcattgaaggactggaactttccgttgaaaataacaacgccaacttctgcattgtaaatttcagggaaatcaaagataccgttaacttctatttaaaagtaatgctccgtgaaatcgaaacccgctctgccggctatgaaacagtctgtcaggatttgatggaaatccttatcgttcttttcggacgccagaccaatttttctacgattctcagtcccgcaaacaaaagagcgtcccacctctgcgattccgttcggcgctatattgatcagaactgcggggatgaactctccttggagcatctggcaaaattttcccatgtaaacaaatattatctggtacatgcctttactgatgagtatgggatttctcccatcaactatctcatgcatgcccgcgtaaaaaaagctgaaaagctgctggcaaccacagattactctctttctgtcatcagccatacctgtggtttttcctcctccagctatttttcccagacctttaaaaaagtagcaggagtttctcccagcagctaccgcaagacggtcaaatctgaccatggagaaatggaagacctttcccgctaacatacaggcaggaggtcctttatttatactcaaaattcgggatctgtccccagcgctccttaaaatagtgtgccgccatcttcggccgccggtctctggtaaagagaccctttttatttccgtcggcgcgcatgcatccctggattgtggcgaaatccgcaaaattccagacctgctcgccgatgaagaagctgcgcttgtcaaattccacattctgtctgcggtaatattccatctggaactcctcggagaacatttccggcacgctctcgtgaatccccgcaaccgcatccgcgccgtattctgtaatcatcaccggtttgttctgtttttcccagaaatccagttccatatttaatgcgtagcatgccgcgtcaagatcgccagacagattgtaccagccatagtaacggttcacgcacaccacgtccatcgtcctcgtcacgagatctctctcgtagttgttctggcagcacacgaaggttaccggacgatctgccggatcaaggctgtgcgtcagctcatagagcgagtgccagtaatcgtacgccgactccggaaaatgctcggtgtccggttcatttcccatcgaccacatgactacgcacggatgattcttgtcccttgcaatcatctcgcgcagcacctgctcgtggtgctctctgatgtggaaagtcttgtacgggtcgatcttatctcccgcgccgattccaaccgcaggcgtctcatcgatcacaacgataccttccctgtcgcacagctgatacatctcctccgcatacggatagtggctggtgcggaaagaattggcattcagccagtggatcagattgatatccttgacatccaggcacacatcgagtcctcttccgcggaaagccgcgtcttcgtgttttccaaaacccttaaaatagaacggttttccattgatcaaaaactgcgttccctctaccgccaccgtgcggatgccgaatgtctcctcgtagagatcctccccgtaagtgacactcgccgtatagaggtacggctcccccggccacggccaccacagtctggcatccgggattctgactgttccgcccgctccatccgccgctgccacctcattgccgtccgcgtccagaatacggatgcgcacctcatcctcacatacgctgcccgccgtcttaatctcataatttaccactccggtatcgccgtcaatatccggcaccagcgtaatgtcctcaatataagccgccggcgtcgtatagatgcggaccggacggttgattcccgcataattaaagaaatcaaaattcggcagattctgcggttttctccataccttcgccgcttcaacactcggcacgcccggattgtccgatccgaaaaatgccgtgctgccctcatttccgaccggaagcgtgctgtgatttacccggttgtccgccgcaacgacgagctccgccgtctctcccggcacaagctgatctgtcacatccacctcaaacggaagaaagccgcctttatgcgcagtcagaaatctgccatttaagtacacctttgcagcatgtgtaaccgcgtcaaagcggagcacgagacgctgtcccttcagataggacggaaccgtgatcttgcgctcgtaatacgcccagccgtaatggttccggtatttcgggtcgtccttctgatcgttgtacgatgccggcaccgccatcagctctgtgtcctcccccatcactaaggaatctcccggctccttctcatctcccagtttaaaattccatactccgccgagatctatcaccccgcgtactctgttctctcttggatacaacatcttttcttcctccattctttctactgatttcttcccgatagcttttgtctgggatttcttttattttacatttcttttgactgctctatgccgtctatcgcagcatggatttccccatcctgtttcgtgacagtatacatttttccacgcacccgcacggacgcatggaagtaatccacttcctttggaatatgcggtgcaaaatcgcagccgccttccggcgacagatggattccggcgatctcctctaagatcacaggcacgggcgcactcgcccacggatgacacaggctcgtgttccacttctgatctttcccccacgcctcaaagcaggtcgtcgctccctcccgcagcatgttacaccacccgtgatcgctgtcgtttagcagcagcctgtacacactttcataccgcccccgccgtgccagtgcaagcagcaggtaataacttaacatcacgccgcaggaaaatccccgtttttccagaaactcaatgacaggtgcttcctctgcctcctccagaagcccgaaatacagggcatacacgttggagtgaagcgatgtgtggctgcttgtttcactgtctgcaagaagccccgtctccttccggtaaaacgccctgcgatacgcgaaaaccggcttctccagctcatacggctcctctctgcccagcacacgggcgagcccgttgagcgtttttttcgcaccgagatacagggcattgatgacattatggcaccccgcccccacaacgggtcttgtcagcgcaaaatcatactcatcccgcagattttcgggccagtcgaccagattccacttgtctgccacctgcacaagcagcccgtccgcgcgctcgtactgcgcaaaatgccggatcatgccaagcgccgtcttatagtatggaagcagcgcagccgcgttgccggtgtaacggtagtatagtgccagcagctgcggatacatcagggaataatcggcgatctcctgcatcagtcctcccggtgcaaccgccagaagccccgggcagactgcccttgtctgcgcaaactgatcaatgcatttcaaaagcatctgcgtctccccggtcagcagtacctgcgcatgcgccgtcacaacggcatccccgagatattgtcctttttctctggtcgggcaatccacatagccctcctgcgttccgtattttaccgcgttcttacagatggaaaaaatctgctccagccgcttttcggaggacgtcacctctgcgccctcctccatcggatagtggcgtgtctgcacaaaaatcccacaaatgttcacgcccttccccggaagcagctttgcgtagcggaatcccttgtaatcatacggttccagactgcagcagccgtctgagagcgtccagatctcgtggtaggagcagttgcagcgcatctcgtagcggacgctgccgctctcatccagttcctctccgcagaagatttccacggtatcccccgcgcttccctccgccgtcaggcacaggcttccggcgacttcctctcccacatcgatccggatgctgccatcctcatagatctcgactttttccggcttgatgcgctccccgcaaagcatccgcgtcggctgtaaatacaaccggtaatccgcccactctgccgcagccggcgtcttccatccggcatcatcaaattccgcactgctccatccttccgggaattttctgctgtcaaagttttccagaaactgcgtatcatatccgattgttccgccgctgtacgcatccgtcctctcatagcaaaaacgaagcggtatccgacagtcctgcgcatccatcaactctgtggcaaacgcaaagcgcaggtcgccgctgttgtatacacggttgattaacccctgataatataaatgcagtccgaagcagtgctctccggcctccatcttccccagtggaatctcgttgtaatagtagtgatccggataaccgggcgcaggtccctccgccacaaatccggactccacgtacagcttgtagtgatcgtccgccgtcagtcttaacgtcaggttctcctgcgccgtctcaagcgtaaaacgcgcacgcaccagaacatgcagattccgccggaattccgctgtcagctgttgctctgcctccggttgtttttccccttcctcctgctccttgtgaaacagattaaccggtgtgatatgtgaaaattcgcggatcgtaagccactgtggactccattctgctttttctctgctcatctcttccgtcatcccgccatcctttccgggcgtttgctcttctgtctgcaattttcctgcttccttcttccgggcagtcgtactgcacagattcccttacagacagcttcctgattttttattatggtataaaaaaatagtgcatttttccatagactttcttatgaaaaaatacactatttctatgtcatttttatgctgcctgaaattacttactgcggctgttttccgatgtaagcaaggataccgccgtccacatacagtacgtggccgttgacaaaatcagatgcgtccgaagctaagaatactgccggtccctgtaaatcctcggcgcttccccatcttgctgccggggtctttgcgatgatgaactggtcaaacggatgtctgcttccgtccggctggatctcgcggagcggtgcggtctgcggagttgcaatataacccggtccgatgccgttgcactggatattgtactcgccatactccgatgcaatgtttctggtcagcatctttaagccgccctttgccgctgcataagcggatacagtctcacggccaagctcggacatcatggagcagatgttgatgatcttgccgtgtccttttttgatcatagacggaatcaccgccttggaaacgataaacggtgcgttcagatccacatcgatgacctgtctgaactctgctgcggacatctcgcacatcggaatacgcttgatgatgccagcattgtttaccagaatgtcgatcacgccgacctctttttcgatctttgcaaccagtgcgtttacctgctcctcatctgtgacatcgcagacatatccgtgcgctttgatgcccagctcctcataagcggcaagtcccttgtcgacaagctcctgcttgatgtcgttgaatacgatcgttgcgcccgcctgtgcatatgcagatgcgattgcgaatccgatgccgtaggatgcgcctgttaccagcgctacttttccctctaatgaaaaattaaccatagttttccgtcctttctttttccctcttattgatctggtactgctcattgcttacacctagtatatcatgtgcaaaaccagcacatgatcaacattcgccgttcgtcaatcatgcaagcatgttgactcacttgcgctcattatatcatgtatgttattccatttcctgcaatattgtattataaatcttgcaaatattgaacttttgtcctatgctgtgtaaagagacatgcgctacagaacacataacaccacaaggcacatagcgccactggcgcattaaaaaacggcggcactaccgcctggaatcgtaagaacggagaacctatgaatagctgtataacctgcaaagaagccatcgaacactgcatgagcacccacacattcgcgttcgcccatctctacggcgatgagaaaatcatggacatgcacattcacaactgctgcgaagtctattactcgatttccggcggaaaacagtttctgatcgaccactgcctgtacgacatccgccccggcgatcttttcttaatcaaccaatttgaaagccaccacctgacacagatcgatcagcagacacacgagcggatcatcctctccatcgacccggaatacttatcgaagctctccaccggcgtgacgaatcttggccattgtttttctttccgtgacaccagaatgccgcaccagatccacctctcccccaaggagcagaaccgctttatgtactttattcacgagctgcatgacgatggcggcatgggggaagacctcttggatcaggcaatctttctggaattgatggtctttttaaacagagccttcgccgcccgctgcacagacgccgcagcccccgccccggctccatcttccaattaccacgcccaggtggacgccattttatcctacatcaactcccatatcggcgagccgctgacgctcgccggtctgtccgcgcatttttttatgagcacgtcctatctgtgccgtattttcaaggaggccaccggcaccaccatcaacaaatacatcaccgcaaagcgcatcaccctgtccaaatcgctgctcgatcagggctactccgtctcggaagcctgcgaggtctgcggcttcaacgactacagcaattatctgcgtgccttcacaaaagcagtcggcatctctccgaaaaagtacgcgcagtttcactcctgaccggttatatctgttccttctgctctacctcgcttataaatttttctatcagcctgtttacttcatccggctggtccgtattggaattatgaccagcattctttatccatttaagcggcaacccttctctctgatgccatttcttattatagcttttggctgagcccgctttatccttttcgccacagataagtaatgccggacaactgatatgatatggcagatctgctttgatcgcctcagcaagcattctgtaaccaaaaccggcaagccttgcatattcttcagaatctggatcataggacatcatcatcttccgcataagattctgaccataatccgtctctgcacatcctcttgaaccagccctaagaagtgctttccatggatagatcttatataatggctctgctctttcaagaagccatatttccattgctgtcatataagacttttgaagcggtgcagaatcaatggagataaagccttttatcttatccggatataattccatatacatttgagccagatatcccccatagactgaccgataatgatgggattataaatttcttcttttgttaatatttcatcaagccattctgccatgtcagacagactgtaattattcataaatggtctggataatgcatgtgatggtgcatcccatacaaacacattctgtttcttctcaaaatattctgtctgcttttcaaaaagcctgtgatctgctgtaagtcccggcaaaaacactaacgtaattttctgcttgtctattatatttacaaaataatggatgcagccacagggtgtcttataactgttttcggtcattttccatcccttttccataaactatttcccaatgatttatcatttccagatattcctgctcaaaagctgttacatcataatttcctgttctgtaccaatatttaagcatcccatctgaagcatacagaatttctttatatatactggtaaactctatatccttacggatgaaatcaagattcaaaattgacagaagcatttccaatgtcttttttgcagcatcctgtacatccggttggatgatggattgaatatcgggctcggtttcaaaaaaaatcatctgtttcatataccttatattgacgcatgtacttttttgttaaatccgctgcatgcttccatagaaaaagatatagctcctgcttgttatgaaaataatgaaacaaaagtgacttggatattcctgcttctgccgcaatttctgaggttggtgcctttttatattgattcgttgcaaatactttatatgcagcatttaatatttgcgattgtttttcttccggcaatgcataaaatttttcattcataagctgcctccgttgaccaattcggttaatgcgagtatatacccgttgaccgattaacggaagaccccatttgatcatctatccctgcaacttttgattttgtatttccattcattgaaaaaaggcatcaaagccatctctgttaaagttacccttttttctgaaatacatatcaaaatcatttcaaaaattagcttgacatattaccagattgctttcctatctatctcgctgataaatttttctataagtctgtttacttcatccggctggtcagtattggaattatgaccagcattctgtacccaaaaccagcaagccgtgcatattctttatccagtgcaataatcctgggatggtctttattgtctgccttcttgtattgtgcatttaccgctccaaacagcggcacatccatggccattgctttttcgcctccgccgaaccgattaaacgcaacattggtcagtggcttctttgtctcttcctcaagtttggctttttctgtatgaatcttactccggaagtgccctgcaacccgttcaatatcttccaccgtaagcagttcccgatcacgaagaagaatctgctccagatccaccgtatccagttcccggtcattatccgctttacacggcttcccgtacttaattaactttttaaataaacgcaatcatatacagcggcaacgtaatgattccctcctcgctcacacctatattgccatccgcaaatttgtatccgtaagatatatctttgttattcttcataagccattttaatgaatttgcccgggtatttctgctcttgacttcgataggaaccacgctcccgtctttctggatgataacatcgatttctcttttcgttgtgtcatttttatagaagtatatctgatatcccttcttataaagagcatctgctattgcacattcatagataccgccttttgagtttccagctaatgtattttctacaatatgctgttttaaagaaaaatccttcatcgccatcagcagtgataaatcagttgtatatgcccggaaaaagtcgtctcttgcataatcatccaaatcaaatctgacatccgtcacccgtttgcataattgcaccatatctgctcgaagcagccattcaacacttgaataatacttttgtgcccttccgccatgctcaatttctttatactgaaatttatggttttccttatctaatagctgctttgcaagcgagagataacatttttctgcctttaccttttcttcagcagttgcataatgtgctatatcatactggtatccctgtaagagatttctttgaaccctgtcaacttctctgaaatcctttatatctatatatttctgtactacttccggcataccgcctgttgcaacatactgtctgtaataattcatcatctgcgaatgaatcgcctcaggtatcactgtctttgaatgtaaatatccacaaagattctctatcatatcttcggaaactcccattccccaaagaaattcttcaaaatccatgccatacattctcagataatcaacatagccgacaggataggaagacgcacgtttataatcaattcccagaagtgatcctgaggcaaccacatcatatctgttatctatcgcccagaacttgagcgatgtaattgcctcctggcattcctgaatttcatccagaaaaatcaaagtttttccgggaacaattttcctttccggaaagcgaaaacgcatagccataatcatattgtctactgtaagatctccggcaaaaatatccattgccgaaggcatctgcttaaaattaatttcaagcagttcctcaaagttttcctccgcaaatcgttcgatgatatatgttttccctgtttgtctggcaccctgaacaaccaagcactttttatcctttgtatccatccagtttttaatgtaagccgtcgcttttcttttcagcataaagcacctcaaatcaatgaatttcattcctgttattgtttttaatcaacattttagaatatcaaaatgtaatttctgtcaacatttcagaaaattatatcatttttttaatgttcaggcaagctgctaatgggcatatattattgacaaccgttacagaatcatgagaagcgttcccgccacaatcagtacaagaccaagcgccgcccttttcgtcagcttctcatgaaataccagataagaaaaagcgatggtgacaaggatactcaatttatcaattggcactaccacgctcgcaagtccgtcctgcagcgctttgtaatagcagagccaggaaccgccggttgcaagtcccgacagacagataaatccgagttccttcctgtcaatcctgccaatctccttctgcttgcccttcgcaaataccatgatccatgccatcaaaagtaccaccgccgtccgaattgctgttccgagattggaattgagtccctcgatgccgatcttgccgagaatcgaagtgagacttgcaaaaccggcggataggcaggcgtacaaaagccagctctttttctcctgccccacgctcttttccgtctccttcttctggatcataaggaaggtaccggcgccgattaagatgacacacacaatcttaagtgcgctgacttcctctcccaaaaaaagaaacgccagcacaatggtcagaattgtactggacttatcaatcggaaccaccttattcacgtcacctgcctgcaaggcatgaaagtagcacagccaggatgctcccgtcgcaacccctgagagaatcagaaacagccatgtcttgccggatacagccgcaatgccgtcctgtgcccccacgacgaacaccataatccatgaaaaaacaagaaccacgatcgtgcggatcgccgtcgccacatccgagtctgtatggcggataccgcattttgccagaatcgacgtaagtcccgcaaacagcgcagaaccaaacgcatagaaaatccacatacgaatgcctcctctacgatacaccttttctcccgcgtatcacaataatgtcatttaactttaagagtgtgtccttctgcggcaggatggataaatcgtcgcgcagaattaaaaacaccgtcagctgctgctcatcctgcacttctcccacggtctttcccgcatatcttctgtccacaaaaatctccgcaatctccttgatgtccgcatcctggatatttgagatgctgctctttctctgatactgctccacgaatccggcgctgatgataccggtcgggatcgctaccacgccgacgccgagatacgcaatacagatcgccatcagacgccccagcgtcgtgatcggataaatatcgccgtatccgaccgtaagaagcgttgacatgctccaccagacgccgctgaatgcattgcggaacacttccggctgcgcgtcatgctccacactgtacatgcacagactgctcgcaagcatcaggatcaccacgataaacaccgaggaaatgatctgattccgcttctcgtacagtaccgtcgtgatgacattaaatgaatcatatcttgcattcaagcggaagagatgaaagattcttgccacccggagcatccgaaagatcacaaatccggacaaaaagaacaccggaacaatggtcagaatgtccaccacgccgtcaaaagacaccataaagcgcagtctggcgcggcatttgcgcattcccggatataaaagatccgccgtccagatgcggagcacatactccacacaaaaaataaagagcgtgatgacctccaccacgaaaaagaaaccggacagaaagtccagttcctcaaacgtctgtaaaaatgtaaccagaatatttgagacaatcgtaattgtgataaaaatatcgaacgcacggctgatccggttactcttatctccaatctggataatgttaaatattttttctctcaccttatgaatccatctcccagcgtaactctgatattttcggtgtccgacggatcctaccggtcatggacggctccgatcagttcccggatatcctccacctgatagcgctccatgtaggcgcggattccgtcaacgatctcctccgtcgcatgcggatgatagaagttcgccgtaccgaccgagactgcggtcgcaccggcaagaatcatctcgatggcatcctccgccgtctggattccgcccattccgataatcggaatctttaccgcctgcgcactctggtagaccatgcgcaccgcgaccggatgcactgccggaccagacataccacccgtgcggtttgccagcgcaaagcatcttctgtgaatatcaatcttcattcctgtgatcgtattgatcatggagagtgcatccgcaccgcccgcttccgctgcacgcgccatctccgtgatgtcggtgacattcggggaaagcttcatgatgaccggctgctttgcatggcgtttcatctcttttgtgacttcttcgaccatcttcggattctgtccgaacgcaataccgccctcctttacattcgggcaggaaatattgatctcgagcagatctaccggctggtcggagaggcgttccaccacatcaatgtattcctccgtcgtatgtccgcagacattgacgatgatcttcgtgtcatattttttgaggaacggaatgtctctgtcaacgaacagatcaatgcccggattctgtaaaccgatcgcattgagcatgccgccgtagacctccgccacacgcggcgtcggatttccttcccacggcacattcgcaacgcccttggtcacaactgctcccagcttattcaaatcgacaaactccgaatactcctccccggaaccgaacgtgccggatgccgtcataaccggatttttcagtgcgacaccgcacagatcaatgccaagattcatcagaaatccacctcctctgcccgaaataccggtccttccttacagactctcttgttcttcacattggaatgcgcatccttctctgtggacttgcagacgcaggcaaggcaggcgccgatgccgcacgccatgcgctcctccatggagatccaacattcgatgccttcctttgcggcatactcctttaaggcgcggagcatcggaagcggtccgcaggcgtagatcacatccgcggtcagcccgttctcgcggatggcgtcgagcacattgccctccgttcccacactgccgtcctccgttgcgatatagacctctccctgtttgcggaactcatccagcagaaacagctcatcccggtatccaagcacaatctgtttctcgcagtttaactcttttgcgagctctaacatcggcggaatcccaatgccgccgccgattaaaaacgcctttttctcctgcttcgggaagccgttgccgagtggtcctatcaccttaagctgcataccggtgtgcatggaagaaaactcttcggttccctttcccgccacgcggtataccagacggagcgcgccgtcctttctgtcgatctcacagatactgatcggtctcgggagcagcctgctgccttccttacagtagaccgatacaaactgccctgcctttgcatgcgccgcgatctgctcggtgtgcagccacatgctgtaaatatcgtccgcaatctcttcctgtttgattatgattgccgtctcttcaaatttctgttgtgttgtatgcatgatcttttatttttccttatcttcatataccacttgtccgttcacaagtgtcattcgcactttaccggtgacttttctgccgtcaaacggggtattcctgcccttgctgaaaaacgtgttcttgtcaatcacgtacgtctcgtccgggtcaaaaataacgatgtctgcgacctttccaggctcaatatctcccttgtcgattccgataatcttcgccggattgtaactcatcttctccgccatctgcatcggcgtcagatacccgccgagtacaagctccgtgtacgttaagcatgcggcggtctcaagacccacaataccgaacggtgcggatttcatggaggtattcttgtcctcaaacgtgtgcggcgcatggtcggttgcgatcacatccatcacgtcatcccgcagtccctcttttaacgcctgtacatcctccttcgtgcgcagcggcggattcatcttgtaattcgtgtccgcatccgcctcgatcgccacttttttctccgtatccacggtcggctcgatcttcctgatgtcatcggaagtcagtgtaaaatgatgcgggcacacctctgccgtcacatggattccctccatcttagcatgcttgaccatgctgacagaatccttcgtggagcagtggcacaagtgcagtctcgccccggtatcccggcttaacatgatgtccctggcaatgatgatgtcctccacggaattcgtgatgccgccaagtccaagttctctggcattgacatccgcattcatgacaccgccgttgacaagattgatgtcctcgcagtgagcgagcaccgcaatgttgtacttcgcagcaagttccatcgcctctctgtaaagctgtgcattcatgacggatttgccgtcctcactgatggcaggaattccggctttcaccatgccctcgatgtcggaaagctcctttccctgctgtcccttcgtcaccgcaccgacctgcagcacgttggcagcgccgacggtctttgctttgttgtgcacatagttcacaacatccggattatccacgaccggcttggtgttcggcatggcaagaatcgtcgtaaatccgccgtgcactgctgcccttgcgcctgtctcgatcgtctccttctgttcaaatcccggatctcttaaatgcacatgcatgtcgataaaccccggcatgacaaagcagcccttcgcatcgatcacgcggtcgcatttttccttgatactcttctcggttctggccacaaccccgttctccaccagcacatccagtgtctcatccgttccggtggcaggattgattacgcgtccatttttgatcaatatggtcatctttttttcctccattgtatgagttcatcttatcatatccgcctacagttttccatacaattccagcggcacatacgccttcacatagatcccctccgggcggtaatcctcctctaaaagctctccctgctttctgatctgctgcaggattccggcatccgcataggcgatggttcgctcaatcagaactttgttctcgcgcagaagttccgcaagcagttcttttaactcgtcgagccccgttccctctcttgccgagactgccagggtatgatctgccctcagatcatgcagcggctcccgctccgtcaccgcgtcctgcttgttaaaaagcgtgatgaccatcttttcccggatatccagctgatagagcgtgtcatagacaatgtgcatctgcttctcgtgctgcgggttggaagcatccaccacatgcagaatgtagtccgcatattttgcctcctcgagcgtactcttaaacgcctcgatcagatggtgcggcagcttccttataaaaccgaccgtatcggtcagaagaatctcctgtctgcccggaagttctaagacgcgcgttgtcgggtcaagtgtggcaaacagcttgtcctcctctaacaccccggcgtcggtaagccggttcaacagtgtggactttccggcattcgtgtagccgacgatcgccgccacaggcatcccgtttctcgtgcgcttcgcgcgtgtgatctcgcggtgctggcgcacctcctttaattcccggttcagctgtgcgatgcggtctttgatgagacgtctgtccatctccagctttttctcacccggccctctcgttccgattccgccgccgagtctggacatggaacgcccgaggccggtcagacggctgaggcggtattttaactgcgccagttccacctgtatttttccctcgctcgtcgtggcgcgtgccgcaaagatatccaggataatcagcgtgcggtccatcaccttggtgtctaacatctgctctaagttcttaagctgtgccggtgaaagttcatcgtcacagacgatgccggtcgcgccccgctctgcgatcatcgccgcgatctccgccacttttccggtgcccacataggtgcccgggtgcatcagttccctcttctggatcagtgtgccgaccacgacagctcccgctgtcctgacaagctccgccagctctgccacagagtcctcggcatcatccccatcctgctcgctcacgccgaccagaatcaccttttcgatctgatcttccaattcaataatttctgccatgctgctccttttctactgtccgctgtctccgcttccgtctgttccggcatcggctccgctgtcggttccatctgcaccgtctgttccgtccgttccgctgtctgcttctgctgttccgatatcctccgtcacgactacctcgccctgcacttctgtgcccgccggcgtatccacccggctttttaagaatgtgtattcgcgcagtgcctccgcatcatcagggtacgcggctgtataagcggtcatcacctcataagctcccgcaaaatctccggtatactccatgcagataatctgattctgcagcagcgcgcgcctgttcggaacactctccatcgaaagcccctgctcgatgtaggaaagcgcaccgctataattcagcttgcccatctcaatctgtgccaatgcattcatcgcttccgaatccgcgacacccgcatccacataagcctgataatacgtctgcgcgttcgccgtgtcctgctgtgcctcatatacctgcgcaagcgtcaggttcgccgctgcactgcctgcatcgatcgcggacgtcaattctttgattgcgttgtcatactgccccagcaggtagtaaatctcccctctgtatgcaagactttccgcatcatttcccttgatggaaaacgcgtcgtttaagtacgccgtgccgtcctccgccagatcataggcggcaagattcttgtaaatattgatataaagttcataatccgaatggttatacttgaccgcgtccgcaaaatcctgcttcgccccgtccgtatccccggtgccaagctttaaacatccgcgcagatagtaagcattggcgttcttcccgtcataatcaatcatggcgttgtacgtctcaagtgctccctcagtgtcctgtgcggcatactgggctgccgccttgtaatagcagatgtcgatctccagatcggtaatttttccggtgcagcacgcaagcgctccgtcaaatgccgccagtgccccctcataatccccgctctgcatgctctctatgccaatcttgcggtaggaaagctcatcctccgtgcgctcattcgcacatccggcaagaagcgcggctgtcacaagcaaaaacaccgccgcttttcccctgtatgttctatggtgattgatttccattcgtcttctcatcttaattcctctttttactataatgaagccaccaaaaagtataaacgatattttccttccccgcaaggtgatttcccgctgcaacaggcgatatcttccatgtacatgacttttctatctcatgccgtcccgaatcacgcgcgccgtgttctgataggcaatctgctccacggcgtcttcggagagtcctctctttcgcagcgcatcgaaaagcagcggcagcttcgtgcagtcactgatctcaaattcgcctgagattccgtcaaagtccgtgccgagtcccacacattcgataccgcccctgtcaatcagatgcattgcgtggtcgcagatgcgctcgatacggctgaccttatccgtctcgtcctcattcagaaaggtcggttccagattcagtcccgccactccgccacactctgccagttcgcggatcattgcgtcagtaagattgcgcgttgccggcgccagtgcccggcagttggaatgtgatgccacgaatggcacgccgcttcgccgggacgcttctgcgacatcccggaaacctccgtcggataaatgggagacgtcgactaagattcccagttcctgcatatagcgcactgcctcttttccaaatccggtcagcccacggctcatctcctccggcttttgggaatggcagtgtcccagacagttgtcgtcattccaggtcagtgtcacaagtcttacgccgagatcgtaaatttcccggattttgtccattttcccatcaatcagagaaccgttctcaatcgtgagaaacgccgatattttcccttcattctgattctgctttaattcctctgcattgtgcgctgcagcaaagcggtcaccgtactgctccatggtatggcagaaaatgtcatacattttcctcatgagtacttccgccgacggcatctcttctaagccgaaccagtccggatcatttctctgcggcagaaacatcgcaaaaaactgcgctcctgcctctgcctgctgcaggcgcagtccatccaccatcgtgcggtcaagttccagaaacgtctctgttttctgcgctaacgcgcttcccaatgtatcacaatgcatgtcaatataacgcatcattttctccatttccgggcagagttccttcttattttccggactgctgccctgtctttttcttattataaagaacccgcggactttatacaatatgccggccgccggattttgtacagcattttctctgtttccactgttttcatacaaaaaggagcgccttgcggcactcctctctgtgaaagaaatatataaattttgaagcaagctttttcttccgggcggttttccccggttttacagatgccagatgtcctcattgtactgtgcgatcgtacggtcagaggagaagaagccggctttgctgatgttgatgagcattttcttcgcccatgccatgcggtcttcataatccgcatagatgcgctcctttgttgccacataatcctcgaaatccggaagcgtcatgaaccagtctttgttcagaagttcgttgtaaagacgctctaaattctctctgcatccgactgccatcatctcgtcgctcacgataaagtctaccgcgcgcttgatgttcgcatcattctcatagtagcttctggacacataatctgccttctcgtagtgcttgatgacttcctcggaggactcaccgaagatgtaaatgttgtcgtcgccgacaaactgatgcatctccacgtttgcaccgtccatggttccgattgccactgcaccgtttaacatgaacttcatgttggatgttccggacgcctccttggaagcaagggaaatctgctcgtggatatctgccgccgggatcagcttttcagccagcgtgacattgtagttttccaccatcacaacctttaagtacggagatacctccggatcatttgcaatcaactcggacaggcagaggatcaggtgaatgatatcttttgcaatcacgtaagccggggctgccttggcaccgaaaatcacggtgatcggacgggtcggcttcttgcctgccttgatctcgaaatatttgtggatgacgtacagcgcattcatctgctgtctcttgtactcgtgcagacgcttgatctggatatcgtaaatggaattgtcatccagcacgattccctgtgtttttgcaagataatctttcagctcggtctttctgctgttcttgacatcaagcaggcgctgcagaacggaagcgtcatcgacaagcgcgccgagcttctccagctccatcgcatccttcttaaagcccggtccgatcagggattcaatcagatctgccagctcgtggttgcagtgcagcagccagcggcggaaggtaatgccgtttgtcttattgttgaacttctccggatagatcttgtagaagttgttgagctccgtatttttcaaaatttccgtgtgcaggtaggcaacgccgttgacactgtagccataatgaatatccatatgtgccatatgcacgcgtttctcgtcatcaatgatcgcaaccgacttgtcatcgtatttgcgtaccacgcggctgttcagttcgtagataatcggaagaagctgcggaactgccttttctaaaaaatgaatcggccatttttccagtgcctccgcaagaatcgtgtggttggtgtatgcgcaggtcttcgatacgatctcaatcgcctcatccatcagaattccacgctgcatcagaagacggatcagctccggaatcaccatgctcgggtgtgtatcgttgatctggattgccgcgtactcattcaacttgtgcagatcaccgcctcttgccagcgtctcatcgatgatgagctgtgccgcattgctgaccataaaatactgctggtatacacgcaggatgcgtcccttgtcatccgaatcgtccgggtataagaacagcgtcaggttctttgcaatatcctctttgtcaaaattgatgccgtcccctacaaggctctcgtccacggtctccacatcaaacagatgaagctttgtggtgcggttctcgtaaccaatcacatcgatatcatacagtctggactgtaaggtaaaaccgccgaactgtaccgggtaggtcacgttcgtttttgtcagccagctctccttctcgatccacgggttcggctcctcgtgctgtaaattgtgctcaaatacctgtttgaacagaccgtagtgataattgagacccacgccgtcgccgtttaatccgagcgttgcaatggaatccaggaagcatgctgccagacgacccagaccgccgtttccgagagacggctccggctcaacctcctcgatctctgccaggttcttgccgttctccgccagaacctgctttacttcctcataaataccgaggttgatcaggttgttggataacagcttaccaatcaaaaactcggcggagatataataaagcttgcgctttccctcgttgctctccttttccttcgccatgctctttgtcatctcaagcagcgcgtaataaatctcttcgttggagcactgtgcaatgcccttaccgtatctgttgtttacgatttcctgtacgttcatgatatcctccttgttttgcgaagcaaaatgcgactgctcttgcaggagcagaggattttactccttgttttgcatccccaattactttttgtatttccctgctgtatgagaacattatatgcagaagtccactttttttcttgtcatattatccccaaaagtggtacaatcctatcatgaacattttagagtatgaaaactatcaggaaaaaattccacatggtaacccgctgtttccttatatcacctacccttgctcgattccgcttgacttttcacgcgtgcctctgcactggcacgatgagatggaaatcatctatatcaaaaaaggaaccggagcaatcacggtcgatttcaaatcctacgtggtaaccgggggaaccatcgcgctgattctgccgggcaggctacacagcattgaacagtacatgcaggaaagcatggaatacgaaaatatcattttccatccgggcatcctcatttccaaaaaaacggacaccagcaataccgaatttcttgcgccgctgttgtcgggcgtcctgtccgttccgctcttatatcagccgggatctccctgctatgcggagattgccgcctgcattgacgccaacgatgaaatcagccggacgaacccgcccggctatcagttctttatcaagagtcagctctttatgcttttttacattttattcagcaaatgcctcttaaaagagccggcgaaacgcgatcacaagtcgctggagaagatgaagctgatcttaaagtatctggagaaccattatatggagcgcattacgattgcagatgtctcggcggaggtcgggctgagccagtcgcatttcatgaagtatttcaagaatacgatgggcacttccttcatcgaatatctcaatgaataccgcctgaccatggcttcccgcctgttgatctcctccgaatcctcgattcttgccatcgcagaggaagtcggctacgagaatctgtcgtactttaaccgcactttcaaaaaaagattcggcatgacgccccgggattaccgaaaacaatccacgaagcagttgtaaaacgggtcccacagaggattttccttgttttagacccgtttttcttcatttttccagtcaaaatggtgctttttctatgtaaaacgggtccagagcagattttttcctctgccagacccgttttttgcaaaaatccgggtcccacagtcatttttttctcctgtggacccggatacctctttttcacacgtctgaacataccatctggacagtttttctttttctcgtgctttctctttcttttttcttacgattctatatcaaagtcaatgcttcccataccgcagtccagatcaatcgttcccacagccccggcattcgtgactttgtagcttccgctgagatcggaatagctttctccgtttaccgtgagatcccccatgccgcaggacatcttataattatagtcctcttccctgccgcgcagggtgatgctgccatcccccatgccgcaatgcgctttcacattctctgccacaatgccgtccagcgcaaatgatcccataccgcaatccagcttaatatctttataggtgcctccttccagatcaatatcaccggctccaagcttgatgtccagggttcctgtcacagcaaaatctgctcccgtcagttcccctgctcccacattcagctccatcgttctgcagttcacactgcccgatgcaaaatctgcatctgccgccccgatgtcaaagtccatggtatcaaaggtcattttctccggaatctcaatcacaatctgcgcatcataattgtccggaaactgcttatgaatctcatactgaatctgaagcgtatctttattcatatcccctttataatatttttctttgcagccgtaggttctcaccacaaggtttttatcatccgtcccctgcttgacatagatttccgcagcatcaatatcaatatccagattttttatgccggctgcctcataggtataaacttttgcatcgtcgtctgctccccagtcatcctctgtgtcttcttcatccgaagaatagtaaagttcatatggccggatatgccagttgcccgcatccagttctcctctttccgccatgcgtctgattgccccaaagcctccgccaagcagagcggagatgccgccgagcaataatcccattcccccgagaactgccacaatgatcaggcagatttttgaaaattttttcatgctgccgcacgctcctttctcttattaaatggctttttgcaaagcttccagattcctttcaatgcccagggaagaaatcctccgaaaatccagaccacaagaaccaccgcaaggacaccgaacgcaaggacgatgagacctcctcccataagcccgattccgattgcaggatttcctgcaaatgcggttccgattcctgcaccaaagagcaccacaccgcagattaacagtgcgcccatgactgccacaaccgctattgcaattccaaacagcgccgccacaatgccgagcaatgctgacagtatgaccagaatcatcaccagccataccggcgaagtgatgaccagaagaacgatcgcccatcccggcattccatccttctcctgcgtagaatacgctgcattctgcgctgctccctgtggtactcccttcgatgcgttctgcgctgctccctgcactgccggattccactctgctcctgttgctgctccctccagtgcgctctgcactgccggattccactctgctcctgccgctgctccctgcgcgccggaagaacacgcttccccgggctgcacacccagatctttgataatgctgtccgccactttctgcggcgattccagttcttctaatatctttgcctcatttgcctctccggcgtcctcgaaataactgcggtaaaatgcaagtgcctccgttctttcctcctgtgaaatcccggacagcagcgcttccagctgccttaaaaattcatctttgttcatcttcaaactccctcctcggaaaataactctgatattttcgaagaatagtcatcccattctctgcgataatcgtccagcttctttcttccctcatccgtaatcctgtagtagcgcctgttgcggcctccacattctctgtcatacaccataaggcatccatctttctgaagtctacgcaataccggataaagtgtggattccgaaacctcaatcgccactctcacatcctgcgtgatcttatatccatatgtgccttcctcctccttggagacgaccgccagaacaatcgcatccagcagggctgcacctgtattgaacaccatattaccggctcctttcctgttctgtctgatattacttatatgtttataatattattttgttattaatactgtatatcatataatatagtattgtcaatattattattcaaaaaatgatacattcattttctaaaagagaaaaaaagaatcccgcaaacaggattctcctataaatcaaaaaatcgtacatgcatgtgtaacgcttacacaacatgtacgatttatattttccattcgctttatctttttctccggcttctgtccaccctacgcttcccagtccgcgcgtttgataatccccacgccgatcggatacggtccggtgtgaacgccaatcgttgcgccgatctggtaaatctcaatctcatcgatccccatgcgctccctcacgagatcttttaacatctcacgaaaatggcaggcctcctcataatcatagccataaccgatggcaaaactgtattcgcccggctttgcggcgcgttcgtccagataagctttgagcatctcgattactttctgcatggatttttcccggcttcgcgcaatgccggaggcaaaaatctcgccctccttcagagtaataagcggcttgatttttaatgcacttcccgcaatccccatcacttttccgattcttccgccatgctttaagtaatcaatgttgccgatcgtaaagaagattcttccgctctcccggatggtaagaagccgctccaccatgcggtcatactcccagccgaggtcacgcagccggcatgcctcaagcacatacaagccctgcagcaccgtgttgatctccgcgtcgatgactgtgatgcgcgccttgggatattcctctaaaatcatatctctggcggtcgtcgccgactgcatggagccgctgaacttcgtcgtgatacagatacagatcatcgggacatcctgctttgcaagcgggagaaacacctgataataatcatccaccgacggcatcgacgtcttcggaaatacatccgggtgatccaccattctctgatagaactcgcggatatccagttccaccccttctttcagataagtctctccatcaaaagatacatagaaaggcaccaccagaatatcgcgctcttttgtgagctctcttgaaaggtctaacgacccgtcgctgataatttgaatcttttcctgcataaatctccttcacatctgttctgtcagaataaataaacaccgcgctccgtgacacggatctccggaattaccgtaagcgccataaaagaaagggtaacaaacggatctacattctctgagataccaagttctctcgtctccttctgcatggcagagagcttttccgtgacttcctcataccgtctgtcgctcataagacccgcgatcggcagcggcagtacatcgattacctttccgccggacacgatcgcatagccgccctgctgctcctccacagtccggatggcaagcagaatgtcatcgtcattgtctcccgccacaatcatattgtgggaatcgtgcgcaacggacgtcgctacggcaccgccttttacgccaaagcccttgagcggtgccacaccgatctctccggtcttgccgtggcgttccaccacacagatcttattgtatacttcattcgggacaaaatatccgttttctgtcggcacttcttccaccagatgcgtcgtcacgatctgatgcgcattcatctgtatcacatcggtctttccgttgcatgcaagctgaatccgctctctggaaagctccccgacatgaaccgtgtgaagcagttcctccggcactggaacccaataatctttcttatagtcttcctctcccaggatcctgccgtccttcatcacatcggtcggacgcacctcctccagattatcgaggaacacaatgtcggcgtgatatccggctccgatggcaccgtatcccttaagcccgtaaaacattgccggctggtagcttcccatcttgtatgcctttgccaccggaaccccaagtgcaatcgccttgcggatacaggtgctgatatgcccttccttgcggatctcctcgatatgcttatcgtcggtgcagaatgcgcactggtcgagcgccacattggcgtctaaaagcgtgcggattaacgtgtcaagattcttagcgccgcttccctcacggatatagatgtgaaaaccggcgcgcagcttgtcgagcacttcctcagggctcgcacactcatgatcgttctccacgccggccagacggtacgcctgtaccgcctttcctgtaatgcccggcgcatgtccgtcgatgtgcttctttgcaaaaagttccagcttatccgacatccggcgctcgcccttgtagcactccacaaaacgcatggtctccccgagtcccagtactcttgcatcatccacatacttcatcatatcggacgccagaaactccccgcatccgtttgtctccacatcggttgccggaacagaggacggaatcatgaagaaaatatgtaccagcgccttgcccgcacatttcagaaaataatccattcccttcacgccgcacacattgacaatctcatgcggatccgcaacaatggtcgtcgttcccgcctgcaccagcaccttggacaattcgcccggggataccatactggattcgatatgcatatgggcatccaaaaatcccggcaccagatattttccggtacagtcgatctcctgctccccctcgtaggaaccgactcccacgatcgtgtcgccgcagattgcaacatccgcttccaggatctcctccgtgaatacgttcaacactttgccgtgctttaatacaatgtctgctttccggattccgttcgcgcaatccagccgtctctttctgtctaccatagattccttcctctcctccgtttacgaaaacaatcccttaaagaagtccgcgatcgagctgaatacatttgagaaaaatgtgcctacactcgagagcacgctgctgtctcctccgccgtccttaaaggaatggtacagtgactccgcataatccacaaggctgtcaagattgatccccagagatgtaatctttaagagcagatccacgatctgctggcgctcggaatctgacagtgtcacattatatttgctgcaggcatcatcaatcgcctggttgatgctcgcctcatctttcagatcattctgtgcaatgaccgacttgatgtaagcgataaactcttccacttcctcatcggaaagtccggcaatcgactgttctaactgcccggtaaccacgagctcatttaaggatgcgtcgatgatatccgcattgatcgtctcacctgtcatctcctggtatgccttgaatacgccgacaagcgccgccgtgccggagatctcctgcggtcctgcaacgatgatatccgcatcggtaatacccgccgttgtcaacgcatttttgtacatgccgactgtacagtaattgatattcctggttgaaatatttaatccgtttcccttatcgcgttttacgatcacaacggaagaccatgacttgcttccgatctgtgaggaactgatataggaatccagatactgatgctcctctgcattcgttgtatagaccacatcataattgccaaggttcgccggatcaatccccatcagggaaagcaccgtattcttctgggcatccgtcagatccgctcccagcgcaagatatggcttatcatccgcctggattgtcacgttatcactgtttgctcccgtggcagcgttctccgctgccgaagcctttgactgatcctgcgcctctgccgaagtctgatcctgccctgcctgattctgcgactctgctgaagtctgatcctgacttgtctggtctacgacaacctctccctctacattcgctgatgtatccgccgcggatgccgtcacaggcgccgatgcaagcatcaccgcagccagaaataaactggtaactctcattccattctttttcatgtgaaatcctccttccaaaacaagtctctattttactacgaactttccataaaaacaaccgacgttttccctccagccgatttatttatataaatttaagaaacctgtccggcaagattacagttccacatgcacgttcagccacgatacaatatccgccataacctgatcgcggtctgtctcgtttaaaatctcatgacggtcattctcgtacaggcggtaggtaatatccgaaagccccgcatctttgtacataccgtacaccttcttaacgccctcgcccagatctccgaccggatcgtccgcaccggatacaaaaaacagcggcagatttttcgggaccttttttatattctccatctgatcgtcaaacaataccgcctccatcagacccttgtaaccatttacggtaaacaggaatgtacagcgcggatcagcatagtatgccttgacattctccacgttcttggaaagccagctgttggcataatcctttccatataaatcgtagcgcttgtacggcttgctgtaggaaaggctctgcatcaggcggcttctgtaatgccatccacggaatagtgcgatcgtacggcataaaaacagtccaaacttcatcgtgctatccggcattgccccggttcccatgatgacggcgccagccactccctccgggtgaatacacaggtatttgcgcagcatgtaagatcccatgctgtgtcccatcataaaatacggcacgccggggttctctgtctggatcgtcgtgcgcagcgtgtgcatatcctcgacgagcgtgtcactcggatccggctctgcaaaatatcccaattcctcctcggatgcaaccgacgcaccatgtcccagatgatcatgtccgaccacaaggaccccctggtcatttaaaaattccgcgaacggcttatagcgttcaatatactccaccatgccgtgcgtgatctgcaagaccgcccggtactctccgctctccggcatccactttaccgcatgaatcttcgtctttccgtcctttgataaaaaactgaactgtttttcttttgtcatagcattgttccctcactttttattatttatactctctgattcctactctctgctctgtatcctttgcagcaaaaccggcatcatccggcttcccctgccgactgcaggatgctcttgcagacattctccagttcatccgcgctgctcttctgctctgccagttcctcctgcatgccggatacatatttcaggaatgcctccctggcgcgcacattttcgtccgccgactgctgcagcacatctgctctcgcgaccgccgtatcctggatcagccccctcagcccaatctgtccggtctcataagccgccatattctgcgcacagtcgcggtaaagctttcccatggaaatattattctccttgagcagctcgtttaagtggtgtacctgctcctccagagacgcgatccgttcttccgcctccccaagctggtcttttaacgccagcgcctcctgctcataatcgtccgcatatgcacgcacctgctctgccgccgtcacaaaccgggttccgctctcccccattcttcctgcttcgatcgcagaattgagcgccagcacccccatcgttttcgacagttcctccatgcgctctgccctctcaccaagtgcctggcgcatctcgcgaagcgcctgcggagcctccgagatatgcttcatcggcgtcgtaaagtgcttgttgttctccacgatctcgacgaccttttcattctgccccttcacctgctccataaaaacgctgtggttggcgtcgaacgtcgcgattccgttattcattgtgatcaacgtattgtgaagttctcccgccgcctgcgcgccgttctccgacaactccccgttctgctgcatctgctgttcgatctcttcgatctctttttccatctgtgcacgcgaggctgtcatgcgtgcaaactgttcctccgcggtatccttctgtcctgcgatcttatggagcagctccctctcgcgcttctccgtctcccttaatgccgcaagttcctcttctaataaagccttttctctctttccactaaacatagctactccttctgtccacccgccacgttctatttatagttgcgaatgatgagctggacactctccattccctgatatacattgatttccggatagtaaatcaccgacatccggatggcattcgccctgccgcgaagcgcagcgtccacctccgtctgcccgtatttttcgctgtaatactgcttccatgcctccacatccccaaaatagaccgcagagacatgttctcccgccgccgtcataagggacagcttcaacacattctggttcctgcccaccacagacgcccgcagaagcgcaagctccctgtccgcgaactgtggcttactgttgccatttccaaacggctctaagcgcgccagctcccggatcagcccgatcgtcggatacgcggcaggcattgccatatctatccttatcttaggtataaaatcttcttctgtcaattcacagcaggcatttattttgccgcggaataccgccacatcttcgcgcagcgacagccctgccgccatcggatgtccgccgaattttgaaaaacattcccggcacttgcacatctcgtcatacatcgagtacgcttccgtggatctgccggaccccttcaccccttcctcgccgtccgtcagaacaaataccggcttgtggtaggactcccggattctccccgcaatgatccccgccaggctttcatgcaccccaggcaaatagatcaccagcaccttctcgcccgctgttccctcgtcgacgatctgttttgccagttccacgccgtctgccgtcatgcttttgcgctgtgcgttcagttccacaagttcttttgcaattttccctgcattaatctcgtttttttgcaagaaaagattcagcgcaattttggctgtctccagccgaccgctggcgttgacgcagggaccaagcacaaatccgatatggtacgatgtgatctgctccggcgtcagctgattctgtaaaatcaaggcgcgcatgccaaggttcgctgtccggtgcagccgctttaatccctcccgcaccagaatccggttctcatccgtcagttccatgacatcgcccactgtcgcaaacgccacaaattccagaaacgcgaatgcctcctccgcgtcaatacaaaacttctcgtaaagcagctgtataatcttccacgccaccgtcgccccgcagagccctttgtacggataggaacactcctgctgcttcggattcacaatggcatccgccgcgctccgcagataccgccgcactccctgctcctccacatagggaatctcatggtgatccgtcaccagaaccgtcatccccagctctttcgcatgcgcaatctcattgatggctgcaatgccgttgtcgcaggtgatgatcgtgtccatcccctcctcatacgccgcatcgatcagatgctcgttgatgccgtagccgtcacgcatgcggtcgggaatcgcgcaggacacactgccgccgcatcgtgtgatcccctgatacagaatataggtagacatcacgccgtcgatgtcgtaatctccaatgatccggatcggtcttccctgccttatcttttctgacaggatacaaaccagcttctctgactcataaagcagatgcggatcatacagatccctgcatgtgccgttcagatatttatcaatcgccgcatcaccgatcaccccgcggttgcggatcagccgcgctgtcacgggactgatgccaaaccgttctgcaatcgcctgaaaatcggcgcctttttttatttcataccacttttccatcttcacttatgcctgttccatcgtattctgcccgtcgccttcgtattccacggagagaagcgccagccccagtgccggtgccgtgtagcccgccgcctgtctgtccctcctggcaagcacgtccgtcatactccccggctctcttctgccgtctcccacctcaatcagtgtccccgtcagaatccgcaccatattctgtaaaaaaccgttccccgtgaaaaaaagatctatctccgattcgtgttcctccacacgaatttcataaagcgtccgcactgtggactttttcattcttgtattgccgcagaacgacttaaaatcatgctcccccagaagaagtcccgccgcctcccgcatcctttccacatcaagcggaatcctgtaatcatacacatacctgcgcgcaaagacgtccggaacctctcccgtatgaatccggtagcggtaggttttgcacactgcctgatagcggctgtgaaaccgctcgtccacctctgtcaggctgcttacggcaatatcctccggaaggtaacggttcaatccatccagcagctcccccgtattgcgcggctgcttaagatgaaaattggcaacctgcccgatggcatgtactcccgcatcggttctcccggaacctatgacatccacctgctgtcccgtcatccgtgtcagaacagtctcaagcttgccctggatcgtcgcgtccgtcgcatgctggctctgccatccgctgtagcgcgtgccgtcatactgtattgtcatcctgtaattcgccataaaattctccaaaaaagtccccagtttgtaacttattctatcacaaaccggggaaaaaaccaacctctaaaccagctccgcaatgcgcgtaaccgcgacataaatctcggaaatacggtaccaggttcgaaagtcgatcactcccgtgaccggaagtccgaagatactctggaaacgctccaccgcctccctggttgccggcccgtagattccgtccggcgtaatcgtcggaatggccgggtaggaacgcgagatgcgcgccagctgttcctgaatctgccgaaccttttctcccgtcgatccgaccgacagatcgactctcggccaggacgccgggatgcccgagacctcctccgccgtgttgataaacatgttattgccgtaatagtagcgcagaatctcaatcgtctcataattctgatcgccgagatacttgcttccccactggctcagccagttgctgcaggtcacgcgctgcccgtcgcaatactgcgttaagatcggctgtctgacattcggtctggagagatagttctggaacatctcatccaccacatccgagatgctctggtaaatgttgcgcccgtacatgaatttctggtcatatgccgtggaggacgtgatcgtaaagctgtagcctttgttgcggtaccactccgtgtatacacgattgagcgtaaacgacatgatggcaagaacattcgcccggatcgtcgcgtccggccaggtcgaatagatctcgctggaggcaacgtttttgatgtaatcccgataacggacatagtagtctctggctgtcgggtcactcggagcgccgtcatgtacaatcacatattccgggatcaccacacggcttaaaacgatctctccggtttccgtgacgggtttgatctcggcttccgcgatcttgggcggatattccgcaaaaagggtatgtgccggaatgacgatgttatcggtcatgctttcggtggtttcctcggcgtccatccggatttcctgcagcgacagctgacccgaaaagacctcaatgccggagatattgatcggacgatatccttttgcagtgacctgaatggtatactccgcgtaaggctgcacctcgctcggctgcattgacagttcaagcggaggcgtatcaagcgtaagtgtttcggacattccggaagcatccgtgttcacctcctcgaccgtgctgtcgggatctccagaataggagatcgatatttttgcatcgtcgatcggcgtgctggttccccgctcgatgacctgcatcctgagatccccgcgatccacattctcgttctgtgcatatctgatatctggcataaaaacctcatcgattcttttcgtattatcatatgccggtgccagatgaaatgtgcgcatccgccctgccgaatcctgccgcaaaaaaacggattgtcactttgagcagccaaccccttttgcacgacgaggaatagaatgggaagatcatgcctatcgatttctgagggaatgcatctggaaattcggttcaaaaaatgtggcatttctaaccagccgaatgtttgcatcttcgatgatccgtgtttttccaagtttggagcactccgcgggtcatgtccgcatcccggaagacaatttgtaggacttttgtgtatgtcccttattggcacctctgaacaaaacataaccgcgcgaagccgctgtctgaggcggcatctgccctattttcaatagcagatgccagcgagttcggttcgcgcggttttatattgtctgtgaagaggtgccattagggacaccagaaagtccgcccattgtctccggtgtgtcggacatgccccgtcggattgtccaaacatggaagagacacggaattcgatgcaaacattcaaccggaagaaatgctcacatttttctccaacgaatattccatctgcatttccctcagaaatcggcaggatgtacttcttatcatattccttcgtacgccaaaaagggattgtctgctcaaagcggcaatcccttttccttccgttatatgctaagacacgcgcgtctcatccacaccttccacagatcttctgctttattctacggtaacaacctttgccagatttcttggcttatctacatcgaaccccttatcggaggacacatagtaagcgagaagctgcaatgccaccgatgccggcagcaccatgaactcatcctgcatatccggcagcgtgaaaatctcgtactccttcgctaaatctcccacaatgctttccttgataaaaacgacaacgtccgctcctctggactttacctccttaatgttggaaagttccttggacatcagtttttcctgcgtcaccgttgccaccaccggcgtatcctgcgtgatcagcgcgatcgggccgtgctttaattctccggatgcgtacgcctccgagtggatgtaggatacctcctttaacttcagcgatccctccagaagaatcgagtaatccagtcctcttccaatcatgaacaaatccttagcgccgagcacctttttggcaaccacatggatatccctgcggcgctccagcaccttcttcatgacctccggtgtccgctgcagctcccgcacaaagctctgggtctgcgcgtcgtcgaagacacctctgctatgcgccatacgcgccacgatcagataaaataccgcaagctgtgtcgtgtacgccttggtacttgccaccgcgatctccggtcccgcattggtgtagagcacatagtcgctctctcttgcaatggaggaacccttgacgttgatgatcgcaagacactttgccccgcggttcttcgcgtacttcaccgcctctaacgtatcgatcgtctcaccggactgcgacactgcaatcacaagcgtcttctcgtcgatgaccggatccgaatacatgaattcggaagccatctgcacctcaatgtgcatgtgaagaatggacttgacgagcgcctgtgccaccagtcccgcgtgcattgcggttccgcacgctacgatgcagatatgctcacactccgtaaaaagagtgtccggcacgccgtctgctgtaaaatccggcatacctccgacgatacggttcttgatggtattctcgatggcttccggctgctccataatctctttttccatatagaacggatagccgttcttcccggcgctgtttaattcccagtccacggtcagatacttcggcagcacctcattgccgtcaaaatccgtcagtgtcagtttgtccgcggagagctttaagatatgatactccggcacgacaaaataacggtttgtaaaacggcagagcgccgtcagatcactggcaagcatcgcgccttccttacagatcgtcgccacgatcgggctgacattgcgcgttgaatagatcacatccttctgatcttcaaataaaataacaagcgcaaatgttcctttcagcttggagacggtcttcttgatcgcttcccccggattcccttcgtagaaccggttcaaaagcgctgccaccacctcgctgtccgtctcggacttcagtgtatctgccagatcgtaatccgcaatcagttccctgtaattctcaatgatgccgttgtgtacgagtgtgacttttcccacttgatgcgggtgtgcattgcagtcgtttacaccgccatgcgtcgcccatctcgtatgaccgattccgcactgtgacactactttttccgacatacagatcgcccgcagatcactgactcttccggcacatttgcggacttctgtcttcccgctctcctcgtcgcgcagggcgatgccggcgctgtcgtaccctctgtactccaacagctccagcgcatccaaaaggacttctcttacgtcctcacttcctgtataacctataattccacacatatgatttccccatttctattacaatctgtatataacaatatttttattcaggtctcttctgtttctattccatcaaattctgttccatcaaacatcgtatttgttttgcagtcacccgcatatttgccgatgtgtctcgcactggaacggtgcggaaaggcatccgccgaattttcgatcacctttctcctcgttaacctgccagggcaggtgcatggcgcttagggaatctctgtggattacggtacagatcagattgcgtatctgaacatataacgttccccttatgcagttatcaaggttcaacgtgtttactatactatgatacgcgaaaaaagtccagaggggattctgttttgccgccgggtatgctatacttagctcatacaacagtgaaagaaggaacctcattcatgctcctgaaaaaccaaaaagaagacaccaccgactacaccaaagactggcccgcgcgctactacgacattcctaccggcgcactgcggcgcgaacaccttaagcgtgcaaaagcagaaggctttgccgttcctgcagattcctaccgggaaatgctctgcgagcggcgctttttttccgaaaaaaaagacggcactgtggatggttttttccgcgcctggaccatgatcaaggcttccgcagccgcaggcgtctcttttttccagaaaaagcgtcagaaaaaagaactgctcacttacatgaaggatctttgtctctccccggatgatctgcttcccgaatccgcggatgcggttctcatcgaagagtggcaggattttgcgcggggactcatctcctcctgcactgggagcaaagcctactgttcgacgctctttggttttgtgccgatcaaggatgccaaggtggcggaaaagctcgccgcagagattcttctggtaaccagggattacccggctctctttgatctggcggacgagtttgccccgttccgcaaagtcatgaccgatagcttctgccagatgattgagaacggcgagacctatctgcaagcataaaaaacagccgcacagaatgttttacacactctgtgcggctgttttctgcttatactttcctgtattttatttcatataattcttcacgtctctcgatcctaccttagaatacggaagtctgatgtattttccgttctccagattgaggtcgtctaacgtatcccccacggagagcgcgtaggcaagatcgagcattgcctgtgcctgcccttccttgtcgttgtagacggttcccaccatctcgccggatgccacggcggcaagtcccacatcagttccatcaattccgaccaccaccggccagtccgcccgcttcagatgcgaggttttcaacgcatcgatggctccgagcgccatatcatcattgttggcgattacaagctcgatctccccgtcatattccgcaagcatctgcgtcatcttggtctgcgcctgcgcccggttccagttcgcaatcccgtacgcgagcttttccacctccacgccgttgtctataatcgttgagaccgcatactcggtgcgcacgatcgcatcctgatgcccggcttctccctccagcaccacatactggaagacaccgtcaccgttcttatcagcatccggattctccttgaacgcatccgccgcaatctccccctgcatgattccggactcgaatgctttcgccccgacataatagaccctgtcccagcgctccagatcctcctccaccagttccctgttgaagaaaatgaccggcacattatttttttccgccatatcgatgatcgttgtcggctctgtccggtcgaccagattcacacagatcacattgcagccggcatctaacatttcctcgacctgactgttctgcgtcgactggcttccggccgcattgtagacttccacattgatggcaatgcccgtctgttcttcctgctctgccgcatattcgttgaaatccgtcatcatctgcgatacaaatgtgtcatactgatcatatacggtgacgccgatcttaatgcttgtcgctttctgtacctggccgtctgtcccgcagcccgccatgcttcccagtgacaccagcgcaccaagcccggccgccattcctcttagcatcctctgtgacataacacccttcctcacttctcctgtttctctctgctactgcacaatcgggaacagcactttctggatatccgcatcatacagatgttcccggtcgaccaccagataattgaccttgctgcttctcgtggtatccatgtgataaatcagctgctttgcgattgcctccatgctctgataccccatattgaattcattgggaaccacgagcgtctgtatccagcccttgtccagatagtatacatttttctcggaactgcccacgccgtacagcgagcaccggtcaagtctccagcccagctcatccccggcaaaaaaatccaccatcatctccgtctcgtcattgccgagtgcaatcagaatgtccaccggtttgtcctgctctaacgtatagaacgcgtccttgatgctctccgcctttccttccaggctccactcgacaactgcaccgctctcgcgcaatccctgcgatacccccgtataacgctgctgcatggagcgctggctctggctgcacgcaagaattcccacgcgcttgccggcaaggtcatccccgaaatcggactgcaccgcctgtgcgagcgctgctcccatctcctcattatccggcgccaccaacgcgtagaccccttccggatcaacgtccgtctccagcagaagcaccgccgtctgaccggagagatcctccagctcctgtccggcgtgatccgtattcatctgcagaataatgccgttggctccatttgtgacctgctttttgaccacatccatctcttccattgcggtggaaaagctccccgtcgacacaaagctcaaactgatgttgtaatcccgcgctgcctgctcaagtccctgtctgagagaagtccagcggtcgctgttgctgttctcgacaaccacggagacgcggtaggacgtctcctgcttaccgacgtttagcatattgtaaaacgcccagataatcaccgccaccagcatcaggatcaacataccaaaataaagtctatttttcttcatcctgccgttcccccttcagctgttttagtcttcctccctccagcagttccgtattttccggtgagtacgcaatgtacggaaggtgaatccgcacggtcgtcccctcatccagacagctatcaatctcaagaccatacggctccccgaagcggagtctgatccggttatgtacattgatgagtcccacaccggagccgtgcttgcgcactctgttgttctctgtcaggagcgcatctaccatctcatccggcataccaagtccgttgtcgcgcacttcaacatagacatcgtctcccttccggtatcccacaaccgtaatctcaccgtcgccgtccatggactccatgccgtaatagattgcattctcaagtaaaggctggatcacgagttttaccgtacagcagctcaaaatagcatcctccacctgaaattccacagtgaatttattcttatagcggatcttctggatgttcatataatttctggcatgttttaattcgtcctccatggagatgatcgtctttccacggcttaaggaaatgcggaacaggctggcaagctgcgtcaccataaacaccgcgtcctcataccgctcaccctcgatcatccagacgatggagtccagcgtattatataaaaagtgcgggttgatctgcgactgcaaggcgtccagctcgctcttccgcttttcttcctgctccaccagaatatcatgcatgagctcccggatctgcgctaccgtagagcgcagcgtctttccgagatgctccacctcaagcgagccgcccacatagatatctgggttcatattccccgcttcccagtccttcaccgaatcgttcaggcgttttaacggctttgcgatattggcagagacaaactggtttaaaagaataatcatcagcatggacagcgacatcagaagaatcacgaacatccgcatcccggagattcccatatcaaatgaactcatcggaactacgctcacgatcttccagccagtgtaactgatggtcttgaccgtgacaatgcgcttttccccgtcaaattcctccttgtggctgccgtcctcgtaggatgctgccacaagattgttctccgaaaacagatccgtgtagatcagcttctgcttcgggtgatagatcagttccccgctgccgtccatcagatagacatactccgacgcattgtccgtatttgccttggtcaaaagctgctcgatactgctgtaattcatatccacaagcagcacaccaagtgtcgaattgccgccgcttgtcagctccaccgcctggcttagcgatacgacccagtaatagcggtaactcggatcgtcaaacaaattctgtacatgcggcgtggaaaaatgcacgttctccatctgtcccgtcgcctccgtaaaccattcctgatccacgatgtcgaggttgttcttctccgtggcaaccggcgctgcagcaaccagtcttccgtcgttggtatagcaggcgatgctgatcagattgtccttgttcgcctcatagagaaggttcatctcctcatcaagcgagtccgtcgccagatccttgtccttaataacgctgtagtacatggcgtcggaaatacgccgcatgttgcgcagataactctccagattgattgccgtctggttcagcagctgctccgcgctctgcgtcgtcatatcttccattttattgacaaaacggttgtacagggaaatccccagaatacccatactgatgaccgatacaatcgtaaaagacaatgcaatcgtcatctgaatggactgcggcttgatgtgtttttccaggaaggaagtgaccttctgccgccactgttttactctttctctcatcctctttgcaccctatgcgccctatgcctcctgcgcagcttccatccggcttgtcttatacttggacggcgacatgccgaactgctttttgaatacatagctgaaatagttcggatcggtatatccgactttctccgcaatcacgtaagtcttctcattctgtgtcagaagcagctccaccgcctcctccatccggtaatctgtcagatagttgatgaacgtcttcccggtctctttcttgaacaccgtggaaaaataggcggcgctcacattaaggtatccacagatcgtctcaattccaaggtcagtatccgcataatgctccttcacatagtcgattgccttcgacacaaaggacttcgtcgtatcctggcgctcgttctgcacctgtttttgtaatttcagacagttctcacacagccattcccggagtgcatccgtcgactccagctgcatggcgcgtgtatacacatccccgttgccgccgaacacatcttccaggttgatctggttgttcgccccgaaacgcgacagctccgtgatcagctccataatgagaatccggtaccgctgcagcgacatcttgctacccgcaagcttctccgtaaattccgcaatcgcatccagaagcggctgttcctctcccaccttgacctttttgatgatcttctggataaagggctcctcccacggcagatcggcattctcctgagggtcgatctccgcaatattgatggctctggtattgccgtagagcacacggtaggacacggcattcttcgcgccgagataggacatctgcagttcttccggaccgctgcacacatgcccgattcccgccgtgatcttcgccttgcagacacgctttgccatcttacagatcttatccatgcagtcggtaaaacgcgtgatcgcctcctccgtgggcagctgggtaatcacaatgccatcccccagatatgtcacgatcttgctgtcatattcagaagctgccagctgctcctccgccagctttttcacggagaccgccagcagaaacggatcgatcggaagcgccccctccatcgggttggtcgtgctgatgtgcagcacggtcaccacaaaatagggaccctttagcgtgaggctgcagttttttgcatattcctcgatggagtcctccggaatccgtccgtcgatgagcgacgtcaggaaattttcctgcagcatcggaagactctccagataatattcccgaagcttgtcaatattgcgcttttcgtccagttccttgtccagattgttcttgatccgctcaaagacctcgcgcagttcgttggcattaatcggctttaaaatgtattcttccgcctcgatcttgatcgcttccctggcatactcaaattcatcaaaaccggagaaaataatgaccttgatcttctggtactgctcctttagcttccggcagagcgtaagaccatccatatagggcatcttaatgtccgtcatgacgacatccacggaaagctcctccgccatctcaagcgcttccacaccgtttcttgcatagcccgcaatgcgaaagcccatgccttcccagtccagctttttcatgatgacctggaagacctcttcctcgtcatccaccagcaaaacggaatacaaactcatattctcccgctccttttcactcgcactcattcattcaacctccgtactgatcctccatccgcttccagagaatgccgagaatcaccgtacagattatgatctccgccactgccacatagacattcacaaacaccagaatcgccatcaaaaaggtagccgcaccgaagaacagtagcagctttcctcccgccttgcagtacgcttcctcgtccttcaccggcggcttatttttcccgcggatcgcctgactgtcgtgcaaaacgatcagccggattgcataatacacacagatcacaagtaaaagcagcggaatccccgcctgctcaataatcgtatcaaccgtcaccttaaaaatcctcctgtactctcaaatctaaaatagcggctggttctaatgtcccagccgctattcattataatatactttttactttcttgctatatactttctgatatccagagagattgcgatgaagataacaacaccgattgcaatgtactgtgcgtttgcattcatacccaggtactggagagctacctttaacagctcgaatacggcaacaccgataattgcggatgatactttaccacgaccacctgttacagatacaccaccaatcgtacaagctgcgattgcttccatctcgtaaccatatccggtctggacggatgcaccgccggcttttgcaccgagcataaaacctgcaagaccatacatagctgctgctttcatgtagattaagatcagagttgcttttaccggaacaccggcaacctctgctgcctgtgggttaccaccgattgcatacatgtacttgccgtgacgggtcatgttgaaaatgaaccatgtgatcgccgccacaataattgcgatccagatcaggtagttgatgccgaggaacttaccgttagatacgttcgtgtactgctctacatagccgccgagcggtgttgcattggttacgataagtccgataccatagacgatctccatcattgccagtgtggcgatgaaaggcggaacgtttaagtaagcaatgaaaaatccggtaaccgtaccgaatgccgcacataccagcatggcaatcagtgctacgacgaatacgttgagcggctgcatatccgggaagaattttccggaataatccatacgctgtaacagcataccggagatacatgcaccgaaaccgatcatacgtcctgcggaaagatcacatcctgctgtgataacacagcctgcgataccaagtgcaatgacgagtcgtgaactcatattcatcagaatattcatgaagttgttctttgtgaagaagttatcggatgtgaatccggtatagattaccaggatgaacatgacgatgataactccgttgttgattaagaaatcttttactttctgttgatttgtctttgtcattttcgtctcctcctatctcatcagaatctcgttgcaaagttcataaccattgcctgtgtcatctcttccggctggtcgatctcgccagtaatcttaccgttacacataacacagatgcggtctgccataccaagcagctcagacatttctgatgaaatcatgatgattgccttaccctgtgccgccagttcattcatgatctcgtagatctcatgctttgcaccgacatcgatacctcttgtcggctcatccatgatcagcacatccggatcattggcaagccatctggaaataataactttctgctgattaccaccggataagtttgaaatgtgctcgttcatgctcggtgtcttgatggacagcttcttgatgctgtcatccacaactttgttcatcttcttatgatccagcacaaatcctgctttcaggtacttgttataaatggagacgccaacgttgtccttgatggacaaacagccgaagataccgttgccgcggcggtcctctgtgatgagtccgattcctgcattcatcgcatcgatcggatgcttgatctttaacttcttgccatgcatgtagatctcaccagatgcgataccgcggataccgaagataccttccatcagctctgttctctgggctccgaccagtccgccaaagcctaggatttcgcccttgcgaagtgtaaagctgacattttggaatgaatttgcatggattgagcagaggttcttgacctccatgatgacctcacctggggtattcttcttcgccggatatacgtttgtgagctcacgtcctaccatctttgcgatgatctgatcggtcgtcagctctgacgccggccaggttcctacataggtaccgtcccgcatgatcgtgatgtcgtccgcgatgcgcttgatctcatccatcttgtgggatatgtataccatcgcaacacccttatcacgaaggtcattcataatacggaagagtgcttctacctcattatcggaaagagaggaggtcggctcatcaaagatcacgaccttcgcctgctgggataccgcttttgcgatctccacggactgcatctgaccgatggaaagtgtgccgagctgtgccttcggatcaaaatccatctttacctctttcagccacttctccgtctccgcatacatcttcttgtggtcaatcaccttgagcagtccgtaattctttgtcgggaatcttcccagatacaggttctcagccacgcttctcgccggaacaggctgtaattcctgatgtaccatggcgatgccgtatttcattgcttcatccgggttgttgacctcaatcttctgcccgtccagataaacctctcccgcgtccatcttgtaaataccgaaaagacatttcatcaaggtagacttgccggctccgttctcacccatcagtgcatggacggttccgggacgaagggaaagctgtacattgtcaagtgccttaacacctgggaacgatttgcagataccctttagctccagtttgtactcagccatgtttctcctccttctatattgatacagattctgttgttatctgtgtactgtcgatgttattgtcgatgttttctaatttttctaatctggtctgtcacacaactatttcatatctttaagacaggtgcggatgcccgaaaacacccgcaccttctgcttacctgctatcaatcatcctgcgtggtaattattttaccatgtcaaggatttcctgtgcattgtcttttgtaacctttacatagtcacaaccaatgtaatactcgttggtttcaccgttgatgaagttgattgctgcatcagctgcaccgtgggactgtgagaagtgatcgttgaatacggtacctgtcatggttccggctacaacatcctcaagagcctcggataatgcatcaacacctactaagaagatatcggtacctacggtacgtcctgcagactggattgcctgtaatgcgccaagtgccattgcatcgttgttacagaatacaacttctactttatcgccgtactgtccaagagcgtttgctacgatctgctgtgcctgatcctgctgccagttaccaacctgatcggagaggcattcaacctcaagacctgcatcggtaagagcctttacggaatactcggtacgatactgagcatcaacgttctccggatcaccttctaccataacgtactggatctttccatcgccgtttaagtctactgtgtcaagaccaaggtctacgatcatctcgccctggaaagtaccggactgacgtgcgtcacatccaacgtatgtaacattccagccgttgtcttcccatctctgctcttcctctgcatccggctcacggttgatgtatacgagcgggatatctgctgctacaaccttatctgtgatggtagctgcggatgaagagtttaccgggttaacaatgagaacatctacgccctcggaaatgaagttatcaatctgacctgtctgtgttgcctgatcgtttgctccgtcaacgattgtgatattgtctttggagaagccctgctctaccagataattctcaagctctgtgcggaacagtgtcatgaagttatcggagaactggtaaatgcatacgccgactttcttgtctgcatagtcaccgcctgctgcttctgttgctgctgctgccgtatcggaagcctcggtagccggtgctgctgcatcggttgtcgtggatgctgcgttatctgttgtggtcgtctcgccagaagaacttccacatcctgttgccattgttgcaaccatagtagctgcaaggattaaactgattactttctttttcatctctgaaaaacctccctttttgtattcgtaactccttgttacattatgcattatagcaatggaggtctgtaaagaacatacaatattcttctctttttcttgaaaatacttctgtttcttttgtgtgtttcgtataattttatggtttttcgttttttcttcttgtgcatattttgcagatggctgtttttgaccggttctgtttcgtgcaaatatacaaatgtccctgtgtgaaagacaacgcttccacgcagggacatctgctctgcttcgactttatacctattattatatcatcgttgtgttccgccttttgcgtaccggaagttccacaggaacttctaagatgaactcgtcatagttcattgtagtaccttttccgcgatcgcaaccgcatcgcggatacagtccggacagctccgcaaaaccacgccggtttccacacccttcaattccttacagacaagcgcatggttcttctcggcaaactgtctggtgatctctctggtcagctgataggttgccgccttggtcttcgggttcttcggatcggcacagctgttcttgaagcccgcaagcatcaccgctcctgagaccgctccgcaggttgcctccatgccgcccatgccgagtccgaatccttccgccgcggcaaacagcgtctcttccggcacgccgatctcctccgcaaacgcacacgccaccgcctgtgcacagttgcatcccctgtcatgcaattcgattgctttttcctgttttgtcattttataacttcctttccgttccttataaaatccttataatttgcctgtatgctgtttctgtgaacatcttatcacaacttatcacaagaagtaaacaaggaggattccagaacgtatgaatcagacaacaatcacaaaacaacggggactctcagactttgcgctcaaatattttgccatggtctgcatgattctcgaccacattcactattttttctcatttacagggaagatcccactgttcttttcgtggatcggcaggcttgccgccccgctgttcctcttctgtatcgtggagggttttcttcacacgcacgaccggaaaaaatattttctgcgtatttacgccatcgccattttcatgggactggtgcagttttccttctataatattgcatccggtctcgtccggccggacggctttttcccgcagaatcagatgcttgcatccttttccgtcctgctcgtcgttctttggggcatcgaccggtgtcagaaaaaacagtggatccggggactttctgccatcctgattccggtctttctgccctttcttctgtacgggctgttcgccgtatcggaagcctttggcattccctacggcaattttctcttaaaccttctggtgtacagtgtcctgccctgccacactgcgatcatcgacggtggcaccgccacactgctcggcggcgtgattctctacctgacgcacagacaccgccgattgcaggcaggtgcctttgcacttttcgtgcttgcgtgggacatcctgcccgtgctgctttttatgcccgcaggaacttctgcctctttcttttttaccgatgcttatgagtggctggaagtttttgccgttatccctatgttatgttacaatggaacccgtggacacggctccaaaaagctgttctactggttttatccgacgcacatttacgtgctgtacgcactttcgttccttttgtacctgaccctttatggaatgggttcttgatagaaatgaggtttttatggctcacattctcgcaattgacgatgatcccggcatcctcgcgctgattgaacatgcactccgccgggaggggcataccattacctgcatgccgcatgtaccggcggatcttgcggcgcacctcgcagagtatgatctcatccttctcgacgtcatgatgccgcagacggacggctacgaactctgcagcgccatccgcgacgacacggactgcccgattctgtttctgaccgcaaagaccatggaggaggacgtcgactacggtttttccgtcggtgcggacgactatatcaaaaagcccttctccatcgtcgaactgcgtgcgcgcgtcgcagcgcatctgcgccgggagcagcgtgaaaaacatcactgcctctacatacagggcatccgctttctgctcgcctcccgcgaagtcgcagcaggcggcgtcacgctccccttcaccagaacggagtatgagatcacacttctgctcgccaaaaaccgcggacagacattttccagagagcagatctacgaagcggtcctaggatacgacaagacaggcgatgagtctgctattacagagcatattaaaaatatccggaaaaaattcgccgcagtaaatatggcgccaattcagacagtatgggggatcggttatcgatggaacgcatgaaaaaaaagaaaaaagaaatccggctgcgcacattttttgtgcgctttttactaaagcttgtcgccgcggtgcttctggcgttcctgctgtggcttctccagattaccgtctccgtcggtacgggtctgatcctgcctgcgaacgccgccgaaaaagaggctcttgcctaccttcacaccatcggtgcacatacagacatcgtgtcttccgggattccatccgcctgcagctacgccatctatgacacatccggagcgcttcttgagacggacatgtccgattccctccgcggaaacgcggatcttctcgcgctttccggacaggattccctctccgcaaatatgcttgggcgaacctatgttaaacgccagaccgacacccggattgtggtgctcacctacgatttccggtctgcctttgcaaatcccacgctccggcgtctctttccgagcgctgaactgctggaagtgtttctcctgctgttcctgcttcttgcagcttttgtactcgtcatcacgcggcaggcaaaatacctgtcgcgggagcttattcatctgcaggaagccgccgacgaaatccgcaatcagaatctcgactttaccatccggccgactgccatctgcgaattcaaccaggttgctgcttctctggacgcgctgaaatccgaactttccgcctccttaaaagagcagtggcacatgcagcaacagcgcagacgtcaattttccgcgctcgcccatgacatcaagacgccgcttacgatcgtccgcgggaacgcagaacttctgtctgagacagcgcttgatccgacgcagcaaacctgtaatcggtttattctggaaaatgccgcgcagatccaggactatctgtcgagaattatcgagctcgcaaagacggatgatcccgctgcatgttccgcagagtgccgttttcaggcgcagcttcacacggcatcgtttttcgacgatctgctcgggaatacaaaaagtctcggtcagaaaaaagaactgcatgttcttttttccaccgagactcttccagccgttctgccactgccggaacatccgctgcggcgtattttaaacaatctgctcgacaatgccgtgtgctactcaccgcacaaaggaacggtcactttagatgcctccatccgcgattatagggatgcacccgagaaagaaagcacgctctttctcactgtatccgatgagggacccggcttctgcgaggacgccctgctctacggcacggaagccttttacagggaatccgccgaccggaatgacaaaagccacttcggtctcgggctctccatcgccgaccagctcgcccgcggacttggcggatcgatcgctctgtgtaatgccccggcaggcggagccgtcgtaatcgtaagacttcctctgaccgggcagatacagcgcgatgcggaataaatcctattctaccggaacggtccagccgtacttatccggaagcttgccccactggataccggtcagtgtgtcgtacagcttctgtgtcagctcgccgatcttgaaatcgttgatcgtgacaacatcatccttgtagcggagttcaccaaccggagagatcacggctgcggtacccgttccgaatacttcctctaaggttccgtcatgtcctgccttcatcaggtcatcgacggataatctggtctcgtttaccttgtaaccccagtctctcaacagatgaatcatggaatctctggtaacgcccggaagtaccgtaccctcgatcggtgctgtgtagatctcaccggcgatcttgaacatgatgttcattgtaccgacttcctcgacgtatttgcggtgctcaccgtccagccagagtacctgggagtaaccaagcttttctgcctttacctgtcctaagatggagcctgcatagttgccgccgcacttggtgaatccggtaccgcccttgactgcacgcaccagctcgtcctcgacaagaatcttcaccggattgatgccctctgcatagtaagcgcctaccgggcagcagataatcatgaatttgtaagcggacgccatatgtacgccgagcgcagcctctgttgcgaacatgaacgggcggatataaagagaggtctccggctcagacggaacccagtctgcctccacctttaccagcgcttttaccgcttctacgaacatatccaccgggaactccggcatgcagagtctcgcgttggaattgatcattctcttcgcattcatctccggacggaacagctgaatctttccctctgccgtgcggtatgccttcataccctcaaatgtctcctgcgcatagtgcagcgtcacacaggcaggctccagactgatcggtccttccggcacgattctcgcatccttccagccgtcttccttcgtccagtccatgacgaacatgtaatcggtcatatacttgccgaatccgagatgtttctgatccggcttctcctttaatacgtctctttttacaaatctgatatccattatgctaccattcctttcccgacatataaaattcttgaaatcaattatgatactttcttttttcagtgtcaagattattccaaccgcttatgccgctcatgattgtaagttatatattagtcatcttcccatatccatatggaatgaaaaacgccgcaaaaaagcggagcaggatcttttctcccgctccgccatcggagtctcttttccctattttaccacttttttcaacggaatccagagaataaatgcatacacgcttccgatcagggaagtcacaagctgcgtcacggaaaaggtcgtctggaacactgccatctttgcctccatcggtgccggcagaaggttcggaatcagaatcagcgagatcacaattcccatgaacagtgcctttacgacagatcctgccgccatgccggcaatcagtccgccgtttcctttgcattttttcgtgaccagtcccacacccaggaccagaagggcattgcccgccatgatacacggcatgatcgccggaatggcaccgatgatcgggcttcccgtaataaagaatgatgtgaccggcgtgatcacagagagaataatgccgcagggaattcccacacttaacaccgctaagatcaggcatgcattgatgaccggtccggtaatatagacgctcgtgttcttaaaaaactggctcacgatacagatcgccagaagaaccgctgtcgttgtgatttgttttgttgtgattttcatcgcttcctccttctgatgcagcactccttcgcagatgtaatgcactctcccgtcactgcaccaaagcaagcataatacttctctctcataaaatcaagccgtcactccgccagcagattctccacaagtgcgcagaactcgtcccggctcagtccttccgactgcacattcacggtcacaccgtttttcttataggtcgccagatacccgtccgtgaacgttcctccactgctgcccgccggataatgtgctgctgtcaccttcacaccggaaaccgtcatcggctttaatccgccggatacataggacgtcatctcccccatgtccgttgagcgtgcgcgaatggtaaaccatcccgctgtctcactgttctcataacgcatgacacagttgtcatcgatcacattgccatctgcatcatagccaatctgatacgttttctcctcatccgtctgcacatagccatccggaattgcatccggaatcaccttgattccgtaatagttctgaagctgttcctctgtgagtgaaaccgtcttcgccgcttccgccccgcaggcaatcgatgtctgaagttcctccacttcgttaaaataccagtcaattcccgcagcgctctccggctgggcagcctcttgtataccgtcgccatcctccgctgcgctttgtgccgccgcttcatattccttcgcactctccgcggtgccgtccggcgttgccgcgtcagatgtcatgataccgtcggatgccgcagtatcataagcttctgccgtttccgcgctctccgtctttgccatgtccgtgcgcgccgtactctcatactgctgccatattccgtaggaacctccgatcaaaagaagtgccacgcaggcagccatctgcataaaatgcttcctgcgtgctccgagatagcgtacgtcctccgcttcctgtatgtaggcaggatccgcttcgccgagcgcatccagtaaatcgtccgtcttcatattttccgctcctttccgccgctatgaaagcagcccttcgcgttccagatgtctccgcagttttccccgggaccggtacagcgaagattttaccttactctcgctgaccgcaagcctcccggcaatcgctccgatgccatccatataccagtatctgcgcatgaaaataatccggctctcacggtctaacccctccaggaaccggttgatggacgccgccagttcctttcgctctatctgcgtcagcggctcctcgcccccggcgcagtcatgcagttcttcatatatatccggcatgacgcctccgcctctcttttcggagtgctttctgcggtagcagtccagcgacagattgcgcgtgatcgcacccagaaaagccgccagaagatgcgggcgctccctgggcatggaattccacgcgcgcatccaggtgtcattcacgcactcctctgcatcctgcgcatcatgtacaatgttgtgcgcgatgctcccgcagtaacgtccgtacttctgctgtgtctctgcaatcgccgtctgatccctgtcccagtacagcgctatgattttttcatcctccatgccttctccctctcagttaaaagctctccaccgttccgatgaacaccggaataccggtgtccttctccacgatcgcatataaaaacggcctgtctaaaataatgcgctccggctgttcaaccattgccgtctccttgcacatctccacaaccgtggccgctccggctttcgttccaagcccgtccacatcgatgtgggtcttgtgcagcaccctgctgatgctgatatttcttccgtccgggcagtaccccattttggaaaaatccgcctgttcctcatcaaacgcgagcggcattccaagcgccgtgagcgtatcttttagttccagatcggtctcgcctgtaaattgcggcagacccgtctctatcattgtatcattttcctgccggattgtctcgtgaaacgtttccccgtccagttcttccagccatttgctcagtgacagtccctcctccggaagcagcgccacaaagtcatagccctccttgtaagcccggcaaaagccctttgcatgttccatggtcagatagcggtacgtggtatcgtacatcatggaaacctcctgcccgcttccgtcctccgcataaaatgtggcatcctgtatctggctctcatcatagggcgtttcccactccgcatcaaacgccaccgcattcaccaggtacatgaccgcaagctccggaatctgatccagaatctctgttatcatgccgtctgtctcctgctccaccaggcggttgatgtcccggcaggtcgtctcgtcaaacggggcgccaaagacttctgcgtcatacgccgtttttacggtgtcaaggaaattctcatccggcacaaatacatcgtccgccgtcttcacccacaccgaatcagacatgtggaatctggcgccctctgcatccggcaggctcttgcagatcctgccaagcaccatactgccatcctccgccgacattcccgggtacaaaaccgctcccatctgctgcttcgtgtcgccgtccgctccggtccgcgccatctcgagcgccatcatcacggaaagaggacacaccatcgtattcttcgcgtcctcgccgttctgcacctgctttctgctctcccgcagcagatttaaggaaaactgcgtataggaatactcaaatgcttccctgatagcaccgagatctttttcttccattgcagtatcctccgttcctgtatcttctgcctgtcctgtctgtccgtttgctccggttccttccgtctgaccttcctctttggtcccgtattgtccggtaagatcagtggttgtaccggacattccgctgttcgcacagcctgtcatccccactgccatcactgccgcaagcacacctgccgtcacccgttccattccttttctcctcataagcttctccctctcttttctatcatccggtttttgtctttcatataataagacgcaaaaaaccggaaacggttgcacccatttccggtttttgtaaaaattttctatctcacatcttctgttctctctacagccttaaatactcaaacgcctgatagacatccagcgcaccgtacccccactcccggttcgggtaccccctgtcctccgagcgctttgcaccgcggatgagcatatttttgatcgcggcgttggacatcactggatcgttctgctgcaccagcgcccactgcatgatctgcgcgaccgcccctgccgtcaccgccgccgcggcgctggttcccgtgtaggtcacataattttggcgcagccccggtccatatacactcaccgcaggtgccgcaaagtccggcttgatctcacccgccaccgtgtagccgcgcccggaatccgcatacatgctgttgttggaaacctggtacccgccgaccgtgatgacctgtgccgctgtccccggcgcagtgagcgtcgtgtccggattggatcttagaaaaatcacatttccgtccgtaagcttctgcatcgggagccacatgttatagttgccgctcacaagattttccggataaacccgcacaatccaaagccccttgcgcacatccgaaaagcgcagatagatcaactggtttgccgtctccttcgtctcaatgcggtaatccaccgacacggtcgtcccctcaaagacaaaccggaaggtctgggagacaccggaacgcagcggcactttcggaagccgttcgcccgtcggcgagatcacagatatcgtgtacagttccggcgcgcccgcccacagctctatgaaaaagcccgccatatcctgctccacgctgatctccacatcctcatattccatctcacggcggatcgccccctgaaaatggtgcctggtgttcgcctcgtttcccgttgctgtcacaatcgagcgtctccgcctggtgctgatatagttcaggaaattggacagcgggccgtccgtcccgtgtccccccatgctgttgccgagtgcaagacagatcacaagcggcatatttaacacatttgcaacgtcatttaaataggataccgccatcatcaggtccgtctcctgataggcaggcactccctccggcacgaagaaaaattcccgcagatagcgctttgcctcttttagctttacaacggcaatcccggcgtttggcaccgccccgataaagccgttcgggatatcctctcccccgcacacgactcccgtcacgaacgtcccgtgcccgttttcatcgcgggacggcaccacatcatacggctgctttttttgcaatgcttcatcaatctcctctttgcggtactctgcaccgtacaggattccctccggcggcgttccatcctgtatcgtctgatcccagatccttaagattctgctgctgccgtccgaataccggaacagcgggttcgtgtaatcgacgccggtatcaatgacgcccaccagaaccccctcgcctttcagtgcaagcaccggctgattctgcagccgggtgattcccgatgcatcgagcgccgtcgtatcgagcagcgcgtagcattttggtatcgccgtgtaggtataattcccgatagaaagcggcggcagtccctctcgcgggtagaaaaaaatgtcgtaatcctccgcgatgcgctgcacgcatccgggcgtggacggaacctctgcctccaccccgtacggaatcaaaaaatcataatactcctctgaatatacctgctccctgcaatctgacataaaaaaactccggtcatccattgctttcttaacaatagatgccggagtatatgaatttattccatatttatcaattgctggcagcgatctgcggattctccgtactcccgataccgatgcagccgcgcagcgtgatgaccggactgcccttcttctccacatagtctttcgtgatcgtgaccataccgatgttgtcgtccttgggaatctcatacatgatatccagcatgaactcctcaatcaccgcacggagcgcacgcgctcccaccttcttctcttttgccttgtgtgcgatcgcgcgcagcgcatcctcatcgaacgccagcttgacctcgtccatggcgagaagcttctcatactgctttaatatcgcgttcttcggctcctgcaaaatccgcaccagcgtatcttccgagagcggctctaatgtaaacaggatcggcagacgtcccaaaaactccgggatcataccgaacttacgcacatcctccacggtaaccttggagagcaggttctcgtccttgtcatactcatcctttaacttcgcgcggaatccgatcgaagcctcctgattcagacgctccttaatgatctcctccagctccggaaatgctccgccgcagatgaacagaatattcttcgtgttgaccatcgtcatcggcaccatcgcgtttttgctgctggctcccacaggcacctcgacctcggcgccctctaaaagctttaacattccctgctgtacggattctccgctgacatcccgctggttcgtattgcgcttcttcgcaatcttatcgatctcgtcgataaaaatgatgccgtgctccgcacgctccacatcattgtccgcagccgcaagcagcttgctgactacgctctcaatgtcgtcgcctatgtagcctgcctccgtgagtgacgtcgcgtccgtgatcgcaagcggcacatccaaaagccgcgcaagcgtcttgaccagatacgtcttgccgcagccggtcggtccaatcataagcatgttggacttctcaatctccacgccgtccttctcatccgccgcaatccgcttgtagtgattatagaccgcaaccgacatcaccttttttgcctgctcctgtccgaccacatattcatcgagcgacgccttgatcttgtgcggtgctgggatcttcttaatgtcgataaccggctccgactgcgccttcggttttttcttcttcagcttctgattgttcggcagtccgccctgcagatccgacagattgatcatgctgatgttcggaattcttcccatgttcatattcatcatatcatccatggaaaaaccgcttccgttcatgctgtcaaacgtcttctgcatacagtcctggcagatgcagatattgttcggaatacggatcatctttcccgcaatatgttccgggcgtctacagatatagcagatgtcctcatactccgtgtcctgattctgatctgtgtcatccgaaacggaactctgcattacctctccggtgcctgatgtgctctcatgctccgccacatcttctgcacggggagcctcacttcccgtctgcgcaccgtgagccgcgtttcccgccggcacaccgttatccgcgcttcccggctgtctgctgcctgcagttcctgtatttgtatctgcgcccgtctccggcgcgtcatctataatctctctgaaatcattgtgattcatactaatcctccattcttgcgctgcttctaagcgcatctcaagtttgtgcgaagcacaaatcttgcgtgtgaaaaatcttatttttcacactaatatcccctattcgctttctatcatgaaatttaggttcattataatgcaaacattgtttaatcacaaggaaattacggagatttcatagttattttaggaattcatcaaaaatggcgaaagcctcttttgctttcgccattctctatttccctcatccgtaaaacgcgctctatctgccgtttccgttattatctgtggttccgttgttattattgtcattgccggtcagatcatccacaccattctccactccgttgatgacatcctttccagcctcaccgacaccgtctaccacgtcgtccacaacattgccgtttccgttattatcagctgcgccgttgttgtccatcgcaccgttatcgtttaaagtttcattggtatcgttcactgtgccgttggttgttccgtttgtgccgttggtcgttccgtttgtgccattggtcgtgccgttggttgttccgtttgtgccggttccattgacggtgctctccgtgccggttccgttcgtcgtatcattgacgttgtcattgttcgtaccgcaggcagccatcgcgctcaccgcgaaagtaagtaccagtcctgcaagcagtgttctccactttctcatagtcatattctcctttttctcagaatcacttctgttttcaaggatagtatgaccctggcgctttccttttattcccgcatccgatgtttttcttttgaattttatttttgaaaattcaatcttaagatttgtaataaccaagctctctcgacagttcttcctgtacttttttcacatccaccgcaagttccctgacgcgctctctcgtcatgcggctggtcggtccagaaatactgaacgcgtattttacctctttctggtagccgtgcaggcaggctgcgatgcagcggacgcccttttcgttctcctcatcgtccagcgcgtagccattctgccgcacttcatccaatacttcctgcatctgcgagaaatccgtgatcgtcttgtccgtctttttctcaatgatactctcgttccagatctttttgacttcctcgtccggaagcgtcgccatgatcgctttgccgacaccggagcagtacatcggatgtaccattcccacatgggacaccatgcggattgttccgaccttcgcctcgatcttgtatatatataagatatggttgccctcgcgctgcaccagatgcaccgcttccccggacaggtccgagagacgttccatatacggctttgccacctgcagaatatccatccgctcaaggatctttcccgccatgttgaccaccttataggaaagcatatatttctgcgtcgcctcatcctgctttgcgtatcccatataaataagagacattaacagtctgtgtacagtgctcttgtgcagatccagcgccgtgctaagttccatcagtcccatctccccgtggtccgcaagcgtctccatcacctgaaaaatacgctctgccgactgtaccggatttttcgcttctctctcttctgccatagtatctcccatgctgtatctcagtcagtttcatcattcaatctgccgttccgtattacggaacgaccttgttatcatatcatgaccgccgcccgaaagtcaactccggaatctccgctgtcccggtgttttgttttatggaaaatacatgattttgtttcttgaatcggttgacaaggtttttccacatgttataataattttgtaccattacatgaaacatagttccgcattgtggaacatgaatgataagtaaaaggagaagaatcatgaacaaagtattagaagagttttccaagattggtattatcccggtcatcgcactggaccatgtagaggatgccgcacctctggcaaaggctttatgtgacggcggtcttccgtgtgctgaggttaccttccgtaccgctgctgctgaggagtccatccgcatcatgtccgagcagttcccggagatgttagtcggcgcaggtaccgttcttaccaccgagcaggttgaccgtgcggtaaacgcaggtgcgaagttcatcgtcagcccgggcttaaacccgaaggttgtaaaatactgcgtggacaagggtattccggtaactcctggctgctcaaacccgagcgacgtggaagttgcaatcgagcttggtcttgaggttgtaaaattcttcccggcagaggctgctggcggactgaacatgattaaatccatggctgctccgtacaccaagatgaaattcatgccgaccggcggtatcaacgctaagaacctgacgaactatcttgatttcaagaagatcatcgcatgcggcggttcctggatggtaaacaaagacatgatcgcagcaaaggactgggcaggcatcaccgctctcaccaaagaggcagttgctaccatgcttggcttcaagctcctgcatgtcggcgtcaacaatgcatctgaggaagttgcttccaccgagtccgcaaagttcgcaactttacttggacaggatgtcaaggttggcaacagttccatgttcgttggttccttaatcgagatgatgaagaatccgggccgcggaacacacggtcacatctgcatccagacaaattatctggatcgtgccatctatcatctggagaagagaggctttgctttcgatgagtcttccttcaaatacaatgacaagggtgagcttaccgttgcttacttaaaggatgagatcgccggattcgctgtacacttcaaccagaaataaggagaacatcatgacagatcagaattgcgcatattgcatggaaggtgatctggtagccgcattcggcatcaagatctgtgaacttccttcctccaaggtatatctttttaaggagcagagccacaagggacgtgtcatcgttgcacacaagaagcacgtgagtgagatcacggagctgaccgccgaggaacgtgccgcttacatcgaggacatcaaccatgttgccgaggcactgcatcaggcattccatccgcagaaagtgaactacggcgcttatggcgataccggtcatcacctgcacttccacctcgttccgaagtatacagacgagtatgagtggggcggcgtcttcgctatgaatccacagcagaagttcctctcggatgcagagtataccgcactgatcgaggagatcaagaagtatctgtaggatatgtatttccgttggattttatgaaaccgaggcaaaccgcaaaggtttgcctcgttttttgcttatgctggcacttgcaagagaaaagcgcatgaaaacggtaatggcaaatcattttccacccttggcatccagcattttaccggcgtattcctgctccagttcttctgccagatacacatcgctcatacagtgcatatccgatacgccatcacgaatcagttgatatacctcggaatgataaaagaattccaatgccgcatccagtgaaattccctgccgttttgcaaaacacgcaatgacacggctatattttttttgtagtaaaatcggatttgctgtcatacaatttcactcccttcaaaatgcaggagagacaatgctctctctgtgcggaaacaaatttgcacattcggtttttcataacgcagacgtttgatagcctccgccttatcaatcaatccatcaaaaaacaattccaccgtattaaataccttatcattggcaacaccaccaacaacgagatcataatctgtcgcgtcttttccaaaagaaccatggtagagaatcatacttccacgcccctttctttcatcacattaataagatcatctacgatatattcccggctctgtgtatgcagcacttcatattccggcacaatataaccgctcagaatatcacttttttcggtaaacgcctgatacacacgctctgcatccatccccagttttgccgctacattttcaatacaaaatacgacaaactcgagttcactgtaatttttgattttttcatccgccatcataagcaagctctcctttatgacaatatgaaaaacagctttctcttcttatcactgttagtatagcacttcatatccatatgctcaatcagattacctctaaaaaaggcacccgggtcattacgacccaagtgcctgtatatcctgatccttttgcgtaagcccctaccggtgcgtatcccacagtccgcagtaggcatccaccgggtcctccccgataaatgcgtcgctgccgctcatcagcttctcgatgagcgcatcaaacgtctgatccgcgctgtcgtaagtgttgatatacgttctcgcctgcggaatgtctgccagtacgaacggctgtccgcatccgatcacgataaccggaagttcatgaacataccacgggatctctccgccgcccttgctcatgccgaagcccggtcttgccaccggctggaaaccgcctgcaatgtccaccagtgtgatgatcagatcctgattttcgacgaaatccttgatcggcgtctttccggcaaagtacatattgatgtccaccttttctcctgctgctgcacgctttgcaagtgcgtcgagcgggctctcgtagataaatgcttcaaagcccttctcgatcagcttgtcacgcagacgctctgccgggctcttcttgccgccgcccatatattttgccatcatggttcccatcacgcccgcggataatccgctgacggagacgatcatgatgcgcttgtaacggctcgggatcatcggaagcacatcctcgtccttgtattttacgagagtgattcctttctcggagatttctcttgccatcgccttgtgctcttcgcagccaacgacctgctccatcacctccaccggaggaacgatctcatttttcgcttttttgtgcagtcccatgtgtgctttcagagcaagaatgcggtgcagggcgtcatttaaacgctcctcggtgatgatgccgttctcatagcccgccatcatgcttgcaaaatcctcatccatctcattgaaaaaaaggaacatatcgacaccggctgcaatcgtgtgcggaagcatctcgctgcgcttcatacagcaggtcagtccgaccatgtgggaagcatcggtcagcaccataccattaaaaccaagctttccgcgcagaagtccctcgatcagctccggcgaaagggttgccggcatgatgtcctcatccctgattcccgggttaaaatgtctggtgtacgcaggctgcataatgtgtcctgccatgatggcttccagaccgttgtcaatgaggttctggtatacttttccatagcttgcatcccactcctcacagctcatgtcattgacgctgtctgccacgtgctggtcgcggaagtccagtccgtcgcccggaaaatgcttcgcagcacagcagaatccctcattggtgtgtgcgccgtccatatatgccttcgtcatctcgcacacgcggtccacatcgtttccataggtgcgcagtccgatgaccgggttctcccagttgtagaggatgtcgctgaccggggcaaaggagagattacacccgatcgccgccgcctctttgttggacatacggccgagctcgtacgcgtatctggcgtctcttgtcgcaccgatcttggtctgctggccgatcatggttccgtcagtgcaggcgccgttgccgccattctccgtgttgcacgcaatgataagcggaatcttgctgttctcctgaagaatccggttctgctcacgcacctcggcaccggttgccgggttgtagcggataccgccgatgtggtacttgtccactgtcatcttcagatactcttcgtctctggaggatcccatattgaaaaaaagctgaccgatcttctcctcggtcgtcatacccgcgatggtctcttccacccatttacagtcctcatcggacaggtaaaacggttttgccttcatatctaccatattaaaatatccctctctttctcactccgaatcggcatgaacaccgagattctgctcgaatgcctgattcagttccttttgatattccgcatcaaagcttcccgcaagaagttttggaaacgcttcctctaaaagacgtttccagctctccccctcatgtccgaccagaatcggatagaaccggacgccgtttttctctgccgcgtcccggtctcccggtgcatcgccgaccatcagaatccgcccgggctcataccccatttttctcaattcaccgatgcagaaagccttggttcccgcctcctgcgtcagaagcgtactgcagtcttcggcaagatgatgtctgccccattccgcctcgaccgcctcccggttcgcggacgacaccgccgccagatccgcctgttttgccatcgcatccatcgcagacttcacattcggaaacggccggtcctctgccggaagcgcatggatcgcgcggttggtgcggatgctccagagcagcgctttttcaaaacacgggttatcactcttctgcgtcaccgcaagcagcgccgggttggagagctccttcgcctcttttgtccatgcctcatactccgcaagtccctcgatgttaccgagacctctcttctccacctccgcgagcgccagcgccagtcccttaaaccggttgataccgcgcgtgatggagtagaggttgatagaaagccaaagctccatgcactccgcttcatgctccgtcagtccgaatgttttgatccactgcggtccgaagcaggttctgtgctttacctccatcgtgtccatcgcacagccgtcgctgtcaatgcacacgatacaatcactttttttctgaaaatcaaaataccccattgttccacctcatgtattgccgcctcttccggctcctttgcaagcttttatacgccggagtatgccgcaaatgctccgtcgatcggaatacatgcgccattgacaaatccgcttgcctcctcacatgccaggaacaggacggaaccgatcagttcctccacctcaccaaaacgatccatcggcgtattgtttaaaatcttgccggttctggctgtcggtgtcccatcctcattgaacagaagctttgcattctgctgtgtggagaaaaatcccggtgcgatcgcgttgcagcggatacccaccttggaaaaatgcactgcaagccattcggtaaagttggaaattgccgcttttgcaccggagtatgccggaatcttcgtcaacggtgtgtaagcgttcatcgaggaaatgttgatgatgctcgcaccttttttgttgaccatatcaagcgcaaatacctgtgtcggaatcagggtacccatgaagttcaggctgaatacaaaagagacaccgtccgcatccaggtcaaagaatgtcttcatctgtccgagatcctccggcacaaaatactcgtcgtcggtcgtcgctttcgggttgttgccgccggcaccgttgattaagatatcgcaggttccgaagtccgcagcgatctggtctctcgccgcctgtacgctcgctttctcaagcacgttgcacttgtatccctttgcaatatagccctttgccgtaatgtcatccgcatgcttttttgccgcatcctcatttaagtcgagcagcgctacctttgcgccggtcattgccattgcctccgcaagcacggagcagatgactccgcccgcacctgtcacaacaaccaccttgcctgtcagatcaatctgaaatggtaacttcatgttcgtcttcctcctgatttttatttttatggtatttatttttctgattcttatttttactttgaagccttctccacagcctcaaataatccgttgatataggttgctccaagcgcacggtcatagagtccgtagcccggtcttccggtctctccccagatcattcttccgtgatccggtctcacatatccggtaaatccattgtcatgcagcgctttcacaatcgcatacatatccagagagccacagctggagagatgtgcacgctcctcaaaaccattctcaagcactgcaacgttgcgcagatgtgcaaaatgaattcttcccattgccgcatattttgccgccatcttcaccacatcgttcttgttcgagcagccgagggagccggtgcacagtgtgatgccgttgtgcggatcatccacaagaccgaggaaacgatcaatgtttttctcgcaggtgatgatgcgcggaagtccgaaaatgctccagcacggatcgtcctcgtggattgccatgttgacgtcgcactccgctgcaaccggaatcactctctccaggaaatacttcagattgttccaaagatcatcctcagacattgcgttgtactctgcaaccacctgctttaactcttctctggtgtagcttgcatcccagcccggaagtgtcagatcgctgtcactctgcagcggattcacagcatccacctgctcctgataatataccagggaggtcgaaccgtccggcagcacgtggtcaagctgtgttctcgtccagtcaaataccggcatgaaattgtagcagatgcacttcactccggcttttgccacacgtctgatgttctcgcagtagttctcgatgtagcggtcgcggctcggcttgccaagcttgatgtcctcatgtaccggaatactctcgataacctcaaaatgaagtccggcatcctccacctgctttttcagtgctgcgatgctctcctcgctccacacctctccgaccggaacgtcatacacagccgttacgatcgagtgcattcccgggatctgacggatgttctccagtgtcaccttgtcatctggtccataccagcgaaatgataatttcatagtttcctccattctgcggaagcttgtttccgcgcatgtgatatttacttgtatacatgctatgatattgctccatgtacgtttctttgtttctttttcttgactatatcatgcttgtatacaagcgtcaacatccatctttctttttttctgttttgtataattttttgtatctgttttgtctattattcacaatttacaccggtttttccgcaggttctgctttttctcctgttgtatacaagtgggtattccccggcagattttccttgtttcatcttcttgcgccgtgttccgcgcgtcttaagttccggaaggactttttatcgaaatccgccagaattccgtctactgtcctgcactgtttttcatcctgccccaagaaacagcgttcccgttttttcccgatcctatgtatacatatgtaaggtgcatgtcccgggctccggaaaaatagattgtaatttgttccattgggatttatattagaaatatgttcacattttgaatggtaagaatggacaccaaattgtccacagaggagcatgttatgaacggaaccagacataccggcacatccgttgccgtttataaagatttaaaagaacagattcttcatctggagcttccgccgggatctgccatcagcgagatcgacacggccgccgcattccatgtatcgcgcaccccggtgcgggatgcttttaaaatgcttgagcgcgaggggcttctggaggtccgcccgcacatcggtacattcgtctccctgatcgacctcaacatgatctccgacattctctatctgagggagaccttagagcaggcggtgttaagagatctgaccgcagggtacgacaaatcccaggaattccgcatccgcctgctgttgcagcgccaatgcgaacttctggaacaggatctgcccgccgaggaactcggccgggccttcatcattaacgacaacgagttccacacaacgctctacgagctcgccgggaaacgtaccgtcatggattttctgaccggagtgagctcccagtacgagcgcttccgcacctttttgaatctgggcgaccgcgacaatctactgcggctgtacaacgaccatatcaaaatctggtcgtgtatctcctcgcgggattatgaggggctctcggatgtagtttcccatcacatctacgacggcttcaatgcaagcaccgagatcatctccaggcatccggactatttctgtccgtttcactagaatcttttagagccggcaatccgcaggcggattacgcctgtcggattgtctcacagacgcggtcccactcctgttttaatgacgtcattttctcttgcagctcttcgcgcgttcctgcacgtaagagcgcaacaatcgccgcgctctgctcaaaaagtcccgtaatccccagcgttccggtcagtccttttatggcatgcacctgctccaacagctccgcttcatcctgctgctccaatgccgcccacgccgcatccatatgtgcatcctccggcagctttcgcagatatttttcataaatcgcctgctttcccataaaccgtgccaatgcggcatcataatcgattccggccgcgcgcagtgcgttctcatccatggcagtctccccctatcacgctttttatgattaagattctactaccagatgtaccaatacgcaaacacttatttcttcattttcggctggaaaatcaggcttgccagatagccaaacaccaacgccgccgatatgcccaccgcgcttgcctgaaagcctcccatgaaaattccaagaaagccatattgatccaccgcctctttcacgcccttccacaatacatttccaaatccgagcaacggcacgctggcacctgcccccgcaaattccacaaacggttcatagatctgtatcgctccaagcagtgtgccaagacacaccagaagcaccatgatgcgccccggaagcatttttgttttttccattaaaatttgcaccagcgcgcagatcagcccgccaacccagaatgcattgacataatccatagcatttttcccctttctatcctgcatgctcaatgacgaccgcatgcgcaattcccggcactgtcattccctcattaaaggaaacggtcgagagcagcgctcccgtcgggacaaacaggattcttttccattttccttcctcgatctgccgcataaaatgtgccgagagcgtcactgccgcacacccgcagccggaaccgccggcacccgttccctgtttgtctgcatcgtagatctcaatcccgcagtcggtgtggatgctgctgatgtcataccctccggctctcgtcagatcccagagaatctcctgcccgacttttccgagatcgccggtaatgatcttatcgtaatccgtcacgtttcttccgaaatccgacagatggcggcagatcacgtcactggcggcaggtgccatggccgctcccatattcatcgaatccttgatgccgtaatcgacgatcttgccggtcgtgatccccgtgatgcgcgccttgcttctttttttcccgagcacataggcgccacttccagtgaccgtccacgtcgccgatttcgggcgctggttggcatattccagtggaaaacggaactgcttttccgcgctggcaaaatggctcgacgtcatcgccacaacataatccgcataccccgccgccacgcacatcgcgcccaatgagagcgcttcgccacaggtactgcacgctccataaagtccgaacagcggcacctgatagtccatgagcccgaaggatgtcgcaatgttctgcccgagcagatcccccgaaaacagataacggatgtcctcggttttcaagcctgcctttccgaccgccagcgtaaatgcttccttctgcagggtactctccgcctcctcccaggtgttctgtccgaacttgtcgtcctcgcccaccacgtcgaagcggttcccgagcggtccttcgccctcttttttccccacaatactcgcactgcttatgatgtaaggagcctccgcaaacgcgaggctctgcttcccgacctgtatctccatatcactgcttcctttcgcaagacttttccttagtatgcggcgcacaaacgtgtattataccggtaaaataccattttgatttttgttttcttctgttcacaaactttccagtagtggttcgactttttctgttgtgaatatggtttgttattgcgaaaaatgtttcgttgcccggatgatagtttaactgtccggaaattggggcggctgggcgtgaaattggtttgactgttcagaaatgtttcgcatgatcttgaaatgatcggactgctagtcaaaaacgaaatttcgccggcagacaaaacagagggtgcatgcgagtgccggatttccggcacgcatgtgcaccctctgttttatcgtatgaccattggttgtgttatcactgacctctgtgatcgttgaccgtactgttattgtcatcgatcgcgctgtattttatcacattatggatgatgtttcagctgtcttaaaaatatgctcttctagaaatctacctctgtatcgtagtagcaacacttcaacagtttttccatctcctcctggctcggctgacgcggattcgatcccgtgcaggcatccagaattgcatttgctgcaatctccggcagtctctccaagaatacttcctccggcacgaatccctgctcggtcggatagctgtccgcgccgtaattcttgatacagtgcggaatcttaagatcatcattcatgccgcgcagatatgtaatgaggagcgccactttctcatccagcgtatctccgcccagtcccataaaatctgtgatctcgccgtagcgctttttcgcagtctcatccttggcgttgaatgcgatgaccttcggcagatacatggcgtttgctgcaccatgaatgatatgtgcgccgtaatctgcaaatgcagcacccgtcttgtgagccatcgaatgaacgattccaagcagtgcattggaaaatgccataccggccagacactgtgcattgtgcatggaatcacgtttttccatatctccgttataagagcccacaagatctctctggatcatcttgatcgcatgcagggcaagcggatcggtaaaatcacagttcgccgtggaaacatacgcctcgatggcatgcgtcatcgcatccataccggtatgtgccaccagcttctgcggcattgtctctgcaagctcaggatccacgatcgccacatctggcgtaatctcaaaatctgcaatcggatatttgattcctttttcataatccgtaatgatggaaaatgccgtcacttccgtcgccgttccggatgtggaagagatcgcgcagaaatgtgcttttttgcggagcttcggaattccgaataccttgcacatatcttcaaacgtaatgtccggatattcatacttgatccacattgcctttgccgcatcaatcggagagccgccgcccatcgccacgatccagtccggcttaaattcttccattgccttggcacctttcatcactgtctccaccgatggatcaggctcaattccctcaaacagacagacttccattcctgcttcttccagatactgctttgcgcgatccagaaatccaaaacgcttcatggaacctccgccgacacagatcatcgcgcgctttccctcaaagtcctttaaagcctccagcgctccctttccgtgatacagatcgcgcggtaacgtaaaccttgccatatgctcctccaatccgccacttcctgtggcaaccattttttgcagcctttgcccgccgttactatcataccccaaatccggcgtcgtttctgcatacgttaagtataacatatgcacaaccggcgttgcaattctttccgtttccattctgcaggttttctgcaagagattttcgcatcgtgttctgatatgccgttcccatgttccggcgtggcaggttggggtggattccaggggcttcacatctaaagcagatgactcggttttttagttttttaggttttttagggtttttaggattcttaccgcccgggcttggcggcattctttctaccggtcactttccgcttcataccacgcaacatttctttgtcttccgcacttacacgatatgactccagcattttctgaattgccttattataggtataatcatccagttcattttccagcagaaatgcctgggtctcctgcggaaattttgcataagcagtcgcaattccccatgcgactcccattttgcaataatagccctcatgctttaggctgttatatacggcaagcacacggtcgatatattcaggcaccagaaaatgatccatcagcatcactgccaccacccgctgctcaaattcactctcagacgcgcggtattgcatcaggaaatcccacacctctgcccggtgctttcggacaatcttaaatgtagaacaaaacccatcattgactgaccagtcgtggattttcggaataaatgctgcggcatattccaaaagctcctccatctccgctttcacgtagccaatcacaagtccctgcagcataatctcctcgtaggtgtcatcacgtgcctccttgagataagttctccagtcttcctttgcgagctgcttcgccagcgagcgcagcaccggaagccgcactcccagaatcgaatctgtccccggaatcaggctgctggcaaaatctttgaactgcttttccgcatgtttctctaaaaaatcacgtatctgttcgtttgtcattctttcctctctttgcactgtcaatgaattactgtaaatgcgattctgtgtctgcactgttttctgcgcacaatatgaatctgtcaagattcattatatcatctttttgcgctgctttctgcgcatccgaagttccgcaggaacttctaatatgaatccgataggattcattatatcatctttttgcgctgctttctgcgcatccaaagttccgcaggaacttctaatatgaatccgataagattcattatatcatctttttgcgctgctttctgcgcatccgaagttccgcaggaacttctaatatgaatccgataggattcattatatcatacatcaacgataccccggcaaaaggaattatcgcaataagcctagacctcttctgggtgatgtgtaatattattacaaacacacttggggatttctaataatattacttatcaaagcagggcgcaatatgcttattgcggcaattccatgcaagcgcgttcgcatggaacatatccgtccgctgcacgtaagcatgcgcatccgtctttgcttcatgctcacttttgtctccgcgaacattatgttactaaccgtggattctggtctatgcacgcaaaaacgtgctctcagacccgcaaaatgacagaatagttgacataacaacagtataaaagagtagaacgggtctcagacgcaaaaaagcagctctcagacccgcgaaatagtcaagaacgggtctcagacgcaaaaaagcagctctcagacccgcgaaatagtcaagaacgggtctcagatggcaaaatgtatctcccagacccgccacgacccaaaatgcagtttttataacctcattttctgctgcatcctcccaaaatcagttttttataacctcattttcctactgcaaccgctctggaatcagttttcatagatctcgccgtccacaattcttaccacacgacccgcatgttttgccacattcagatcatgggtaatcatcacaatggtatttcccatctgattcagattttcaaaaagcttcaatacctcttttccgctgttcacatcgagcgcgcctgtcggttcatctgcaagcagaatggcaggttttccgaccagtgcacgcgcaatggctacacgctgctgctgtccgccggaaagttcattgggcttatgtccgatacgctgtgaaagcccgagcatgtcaatcgtgtccatactcgcctcctgagcctccgcgagccccattccacgcatcagaagcggcataacaatattctgcagcacgttgtaggtcggaatcagatgatatttctgaaaaatgaagcctattttctgattacggatttttaccagttccttttctttcgcctgttcgattgccacgccatccagcagatagtttccgctgtccatcacatccatgcacccgatgatattcatgagcgtactttttccggaaccggaaggacccaaaatggcaagatattctccctgctttacggtcagcgacacatctttgagcacatggagggactgcgttcccatgcggtatgatttgttgatatttctcattgtgattacgtctgtattttctatactttctgcttttgtgaccgcgcagatcgccggctccatatccatcactgcatccatatctctataataacctcctcaccgtcttcgctggtctctatcagaagcttcagcagatcgccagccgccagccgctgaaacgtcgtctcggtacctgccgtggtgtgcaccaccgtgctgaccggaatcaatgttgtcacacttttaccactcatgccgccatttccgcccggtgctcctccaccgttacttcctgttccgtccgatgttgcatcgcccggcatgtcgccattttcttcctgcggctgtccgtctgacgtctctgtgttagcatccgttccggaagttccctgcgacatcctgccaggcgcccccgagccatctccagacgcctccgtgctatcccctggcgctcctgcggtatcacttcctcccggcgcccctgaaccatcacttcctcctggcgctcctgagccatctccgcctttttctgtattctcggtgtcttccgtgctgcttgcaagatatgcctccaccaccgattcatcgacttccatatatgtcaattcatttccctcgatgctggtcacataggcatacacatatttctgattatccgccagtgtctccgtgtctgccgtcctgcgggtccatgcgaaaatgcctccgccgccgagcactgctgcaagcgccacaatgccgcccgccaccgctttcttctttatcatgccaaacctcttttcaattatttattccgcgccaagtgcctccactggaaccagattggacgccttataagccggataaaatccgaagatcgttcctgttcccaccgcaaacataagcgcaatcaaaaatgctaacgccgacagttccacacggacgccgaggtactgtacaatcggcgccacagccagcgatgccagattccccagcataccaccgatgagactgattgccgccgcctccgcgaggaactccagcagaatgtcccgcttggaacagccgatcgcttttaagataccgatctcattggtccgctcttttacagatacaaacaatacgttcataatgccgattccaccgaccacgaagacgatcgccgccatcgcaatgagaagcatcgtcagaatctggttggaagcctccgccgcctccatcttgcttcctgcatcctcaaatgtgaactcagcgttcgggtaactggtggcaagcacttctgtcacttcctcgatcacgcctcctacattattcacatctgccgccagcaccgtgatcgtcgggctgaccgatgatccgaccagatatttcacaccggtcgcataagggataaaaatggaatcatccgggctgataccggacgcgaccgttcccatgctttccagcacaccgtttaccacataaagccggtcgtcgatatagatcacgcttccgtatgcctcaatggcactgccgaaaatctcttcggcaacgcttgcgccgagcacgcagactttttctttgttctcatcatcatcgtcggtgataaagcttccgaccgcgagggagaggttgctgatcgtctcgtagttacttttcactcctgcgatggtataggtatcggcttcatcgagatctccgccatccacactggattttgtggtgtaggaaatggtcgctgccgagatgccggacgcaaatgtttcgatgtcatccacatcatcctcgctcagcgtgatattttcctgattcatgcggtcttccatatcgctctgtccgccgaaaaaacttcccatatccggcataccgccgccgtcaccggaaggcatctctccccccggtgatccgcccggcgcctcgcctcccgatgaggaaccgcctcccatatcgccggagggtgctccgccaaaacctccgccaaagcctccgccgccacccggcgccatcattgccatgtcggaatccgaatcatcgctgcttcctccgccgccaaaatctgtcccgccgtcataggaaatgtccaccgcaccggcatttaagtttttaaactggtctgccacgtccgcctgaccgcctttaccaatggcaatgaccatcacgatggtggccgcaccaacgataatgccgatcgaggtcatgatcaccttaaatttgttctgtgtgatattgatccagaccagtctcaataattcttttggcttcattctgtcacctgactttctatcagcacagtttcaccttccgtgagcccggacgtgatttccacgttgaccccgtcagaaaatcccgtctccacatccaccatgcggatcgttccgtccgcatccttcaccttgacataggatgtcgttccgtccgactggaccgccttgttggatacatatagcacatccgtcacctgcctgctgataaatgtgacgtttcctgtcatgtccgtgtatattccagtgatgtccccggtaaacgcggcagtcacattgtaagacaccgtggaggaaccgctggaagatgaagtgtcaatgctctccacctcccccgcaaacgtctgatcctcataggcagacagctcgatctccacgacatctccgactgcaatattcgtgatgtcctcctccgacacggagacggtgatcgtcaccgcatccgtattggaaaaagtggcaaccgttgcgccggaagagatggtatccccttcctcgtactccagatcggtaatggttcccgtatactccgcatagatcgtaccgtcatccccgatggctgtctcaaattcctcaagtgcctcctccgcgtcggacagcgtatcttttgcatcggtaatgtcattgtccgccccggagacatccacactgtactgactggatgcattttttgccgagagttctgcttctttcaacgttttctccgcctcaatggacttcgtggtatagttgtttttcgctgccacaagctttgtgtacagtttgtcataattttcctgctcctcggtaagcgatgcgcttaagtccacgcccgcatcgatctgctcctgatagtaattgatcagggacgccgacgtatccaccgcttcctgcgcgtcatccacagcctcctgcagctgcttgatggcagcttcgtaggtctcctgtgcaacagatccctccgccgtgctcagattgtaggagtaacttgccgatactttttgcttttctgcacttaagcccgcctcgctgacggctgtcttcgcctccgtcaccgcttcctcaagatcttttttataagatgccacgctctcctctgtaagctttaagatgggatcgccctccgcaaccgactgccctgcggtaacatagaccgtttccacctcaagggtcgatgccgtgctggtggacgaagtcgcatttcctcccgcactgttctgcgcggacgagttgttctgcgtgcttgcagaggaagaatcctctgaaaaatcaagagtctgatccagcgtgccgatcgttacactgccgctctccgtcacgcccgccgtcagatttcctttctccacggttacttccttatatacggtctgctcttcactgtcacttcccgactgatttgcaaaggtgacggttcctgcggcaagcactgccgccgcagccactccggtcaccagccaaagctttttcttcttcattctgtctttcctcctgcttcctctgtctcagacgctccgatcgtctcggtttttcctgcggtcttagtctcttccatttctgtggctccagtcgcctgtgtttcaaacttcaccgttgcctgtacgccagtagtaagtgtgccatctgtattgtccacggcaacaatgaccgcatacgtcacattggacatgcttccgccggatgttttttccgatgcgatggaatagacggttccgtcgattgctcccattctgcttccactgatctgtacctgcacggtgtcgccgaccgcaagttttgcaatattgttctgtgatacctccacagaaatcagaatcgtatccagatcgtaatagcttgcaaatgcggtatttttaatcagggtatcccccgcctcgtaagtcaccgatgcaagcgttccgtcacggtccgcacatacaacgccatcctcgatcgctaagagtgcgctctgctgttccttcagctcatccagcgtatcctgcgcttcgtccacagcactctgcaagttttccagcgaagcttcatactcggtatctgcattttttccctccagaaccgcctcttcatactgctgtaaaagcgccggctgcgccgtcatctcattgcgctctgcctcgtcgcaggcgtcactcagctcctccagctcgtctgtcagctccgcaattttctcatttgcctctgtcaccttcgtgttatattcctcgaccgccttctggaatgtctgattggcaagctgcagtgcactgtttgcgctctccgcctctgtctggctctgcgacagggcgtcggctgcctcctgcacggcggtatagtccgcagccagctgatccgccagcgccgcaagatccgtgtgggacgctccggcttcaatctgtgttttcatgttcgccatatccgctgcatatgcgtcctttgccacctgactgctgctctgtgcatcagaaagctgcgtctgcttttccgtgagcgtcgcctgcgccgtatcgactgccgcctgtttttcattgatcccgacctgtgtgtagtaggtgccgttgtcgatggcatcctgataatcggagatctcctccaccgcctcatcgtacgcttcctgcgcctcgctggtctttaccgacagctcgctgactgccgcatcataagtatcctgcgcggtgtccgctgcaagttttgtggaggaaagctcgctctccgcctccagcacgccgttctcaaaattgatctgcgcagattgcagtgccgtttccgcatctgaaatggcatcctcatagtacgcctttgcatccgccatgctctcatcgtcgatcttgaataaggcgtcgccctccgccacggtgcttcccgcttccacgtagacttcttccaccgtcatggtcaccgcattcacagaaaaatcaggcagctggctctccgttttcacctgtgtggttcctgtcccggaaaagctgccgtcttcctgtccgtctgtctcatctatctgtgtgtcctcctccgtctgatccgctgtgcccgaagctgctatcacatgatagccaactccgcttcccgcaactgcggcagtcagaatcccggcaagtattccgtaaaattttttggaatgttttcccaggagtttgtgtacccacgctattttcattgtttcatcctttcccttccggcatttcatcctctctcatgtttcacggtaaggatagcatcgctttctaaagggtagctgaatgtaatgtgacggttatgtgacggaaccgttaaatatctgtgtttcacggtggacagagcgcacatcctttgacagattaggtaaaaagtattacaatacttccgtttctatagatctgttacattggagattattcatgaagaaaattgctttttttgatatcgacggaacactgacttccgagattgacggttcgattccggaaagtgccgtctatgctatacgggcggcgcgggcaaacgggaatctgatgttcatcaataccgggcgctgttttcagaatgtggaacagcgtttccgtgatgtgggttttgacggctttgtctgcggctgcggcacagatatctactgcgacggtgccgaaatccttcatgtcgcacagacgcacgagaccgtaatgaagctgcttctcgcagccagggagtgggatatcgatatcctgtttgaatccaggaaagaggttgcttttgatctggcaagaccgctccggcacccggatgccagacggcagtatgaggcgtttgaagaacgcggctatgagatgccggagcaccttgagaatcctaattttttctgtgataagtttgtcctatggtttgagcaccccgagcagcttgccggtttccgtaccacaagtgaccgctattttgagtgcattgaccggggcggcaatttccgcgaattcgttccgctcggctactccaaagccaccggtcttaactatgtgcttgattattaccggatagacaaaaaggacgcctatgccttcggcgacagcaacaatgaccttcccatgctcactgctttgacaaacagtgtcgccatgggcaacgcctctcctgccacgctttttgacaaggtgtcctatgtaacggaaaaagccagcgaagacggtatccgccttgcgctggaacatttcggttttatctaaagtctgcggttatcccgcacgagcaccacagccatcacaatggctgtgagaagctcggatgccgggaacgacagccacacgccattgatgccaaatgctgcggcaaaaagcattgagcagccaataatgcagacaaatcccctcatgatcgatgtcacaaacgattccctcgcacgttctgtcgcgcttaaaaatcccgctcccacaatattgattccggcaaacagaaagccgataaagtaaagacgcattcccgtgtgggcatacgctgccagttccgcagaatattcactgttaaacagacccaccagcgaatccgtaaatccgtagacggctccgatgagcactaccgcgatgccaaaagccgtggcaagtccgaggtttcgtattttccggacggatttcacatctcctcttccatagcagtcgctcacgatcggctgcgctccctgcgacactccgttgaagattgccattgccacaagcgcaaagttcgcgatcactccgtaagccgccacaccgatatttcccacaaggccgagaatcaggaaattgaacacggtcgtgatgactccggaagaaatctcccccacaaatgccgggacgccaagctgacacgccccgaataactgggcgatggacggcgcgtgcagccggaaccgcacagtattcttttttccaaggaaatgcgcgctgcagatcagaatgctgatgatcggcgatgccgccgtggcaagcgccgctccctctaaccccatgccaagcggaaacataaaaatatagtcaaacagaatgttggaaaaacttcccgcgagggttcccgccatcgctaaggacggctggttatcgttgcgcacaaatgccatgatgacgtagttcatcatgaaaaacggcgtaaacagcagaaagattctcgtatacccggttccaagcgccacaattcccggatcgccgcccatcagcgcgatgattttatccgggataaaaatgcccgcaagtgtaaacaggattccaatgatccacacaaaacagatggcgttggaaaaatagtcgtgcgcccgctcctcgccctgcgctcttaaaatcgtaaagcgcgtcgcagagccgacaccgatcatcgagccgatggcaaaaatcagattgtagatcggcagcaccagatttaagaccgtgattccgtccgttcccgccgccttcgcaataaaaaaggtatcagcgatgatataacaggagatacctaacattccgaatatattctgtgtgacatacctggcaaattgttttgtgactgacatttacttttccccgcagttctttttcatactcattgtttcttatcttacaaccggagtgaaccgcatgtcaagctgtggaggcggcagaatgcggtgcttcccggcttgatatgagatggtatctttttcggttgttcgctttacttttcttttgtagtatgatttaatagaaaccattataatatctttttgcgttgttttctgcgcatccgaagttccgcaggaacttctaatatgaatccgttaggattcattatatcataaccatttttctctatgttcttccatgaatttgttcattcgattgcagacacttttcacccagagcaccccagcgataccaaattcataatcttttctcattatatgccaacgctccttttccacctgtacttaaaacagcagcgggcatttttagcacataaaagtataccggatcctcttaacacacaccatctatagaacaggagaataccatgacacctttacacacacaaatcctcactgcccgcgaccgcaacgggcaggaacttcgtaccatccagaaccagcttcagaagcttcctcccggaaaactcatctgctcccgcaacggaaccactgtcaaatggtatcaaggcgacggtcactccaagacctatattccgaaagcaaaccgcgctctcgccgaacagctggcgctgaaaaagtatctgcagcaacaggagcaaatactcttgcagaaacaggcagcgatcaccgcatatttaaaatattacccggcggacagcctctcttctgatgatccgcatcttctctctgatcccgcctgtgaagatctgcttcgttcttatttttccaccgccaaaaatattccagccgtctcgaatatttcagatatcccgaatatttcgactaattccgctgtcgaatggtctgccgcttcctacgaacgcaatccgctccatcccgagcagctgcttcacaaaaccgtctccggagagagagttcgttccaaatcggaagccatgattgccatgctgctccacctaaacgccattccttaccgctacgaatgtgcgctctcccttggcggcgtcactctgtttccggatttcaccatacgccatcccggaaccggcgctctctactactgggagcattttggcttgatggatgatcccacctacgccaaaaacgccggctcgaaactttctctctatgccgcaaacggcatcattccatccgttcatctaatcaccacgtacgagaccaaagcatatcccttaagcgccggcatgattgagcatctgatttcctactattttctggattccgcggtctgaatccgtacatccctcttccactgtcacttcctgcttttcgtccagcgcgggtctggaacagcgtttttcctctctcagacccgaaaatcacaatatttcgggtctgggagaacatttttcttcttccagacctgggtggcttcttttttctcttctttttccttcttttcgtccacttctcgggtctggaacagcgtttttcctctctcagacccgaaaatcacaatatttcggatctgtgagaatgtttttcctcttccagacccgcacggaaaaggcactacaccattccccaccattttaatccccaatagatgagtccaagcacccagcttgaaaatattccgtataaaatgaccggcccggcaatcgtaaagatcttgcagccaattccgaaaacctgtccttctttctggaactctatggcgggcgcggccacaccgtttgcaaatccggtaattggcaccagcgcgcccgcgcctccccagtttgcaatcgaagggtacagattcagaccggtgagcagtacagacagcagaatgagcagcatagagcaccagcttccagatgttttctgatccagtccgtaattctcacacacgttcagaataaactgcccgatgcaacagatgatcccgcctgtcacaaacgccttcgccatattccaccagagattatgggtgggagtcacctgcttcacataatcattgtattttttttgtaaacgttctttttccttatccactgcgcgacctccgtcttttttgtcagtatgcgcattttatttatttctattcctccgaccgcttctcccgccattttccctctgtaatgctgtgatgcccaggcttgctatgatgcacaagcttgctatgatgccccgggctttatgcgttctgccagtcatccggcaatgtgaccgtccagagatatttttcagtgcgtccccagtctaaaagttcccgcatctgctcatcatatacatcttcgggacggtagtccgccaccatcccgaacagatacttttccttctcatccgctggtgtcagcgtcggtatcttctccgacagaagcgcgagcagttcctccggcttgatgtcctccgggatctcaactccggaaaggttggcgataattcccgcagcataataaaattcataatttcctgtcagaattgacttctgcatattgcacttgataatcacgctctggcgtgcgatggatggcaccataattttcctccgtaaaaaaacaatctcccatcattgtactactgtgccttaaaatttccaaggaaatagtacagcgatcctgccacttttcctgccgccatcgcaagcatgacccagaagagtccgacctttaagcccatgcgccggaatgtaatcggaaatgtattcaggatctccgcgagcgccaccgcgatgcttcccacaaatatcccggcagaaataccgtacacgcacagaagcgccggtccgaacggaatccggatctgcaaaaaaacagacgccagatttccacagattccgcccagaatcacggcattttcagaatgcagtgtctctgccgcgcggttgcactttccaatcatacgcggaatgacaccgatgacgatcaaaaacgcaaatgttcccgcagagacggcaagtcccgcggcaagcccgcagaagcccaaaaatatatgctcaattaacatcgatgctgtgtccctttctctccgcgttctctatgaacgtagtatctatgtccttctcatatttgcgcatctccacctgcatcggcgtcggatccggcgtgatcttcttactgcccacatgattgaaaaacagcgtaatgccaatggcaagtccgatgctgtaacagatttcaagttctgtcacgccgcttgactcctttcccatcacctgccgatagaatttggaaaagacatctcccacggatacatcgttgttgaacgccataatcgtgaacgccgccccgaaaaaaatgaccacgcagagcgcgacggtctttaacgcattgatccacttcggtttctcgggattgggaatgtattcaatgataaaatccttctctccctcattgctgatgtccacattcggatattcctcatgaatcagttcgacgatctttaatatggaaaaaaccttcatctggttcttctgtttgcgcggattcatcacctccgcaaacgtatagatttttttctgcttcagctggcgcacaatcgaagcatccgggcactccattttcgcaatgtccccaagcgtcacatgccggtctgtcacgattgtattctggtcaatcttaagatacagtgtctcactctttgcactcatgccgcagttcccgcttcccatgtagaattccgttccaccagcacgccgtccaccggggtctccccctctctcccgtatttcagatataaaagtgccccgcagatcagcgcgatggccagcactcccacaaggcatgctctgtattttctgcaattcatattcctgtcctcctgtccgtttttacatcacttgcatgatttatgcattattatgcctgtcctcacagatattatgtacaggacaactgacaaaagtaccagattgctttttttataaaaacgtgttactttttcatatggacattttattatcagaaaggcggacatccaaatggctgtaaccaaggaaattctggctctcgccgtggaaatcggcgatgcactgcttcggaatggtgccgaagtctaccgcgtcgaggacacggtcatgcatattcttgaggcatacgaaattgaaaattatgatgtttatgtgctttccaacggaatctttgcaagtgcaaacgaggatcgtgaagatgcctgcagcatgatccgccacattccgctcggcaccacgcatctcgggcgcatcgctgcattaaaccagctttcccgcgagatctgttcccacgaatgttcgctgatcgacgcctggaaccgtctggaaagatgtaaaaatatttcgttcggtaaacctgtcgtccacatcttcttctgcggactaggttgtggctgtttttcctaccttttcggaggtacagccctggacagcatcgtcggcttttttatcggcatgctgctgcaggtatttctgtttgccttaaagcgccataagaattccaagtttatcacgaatatcctgggaagtgcattcgtaacgctgctgtcgctgattgtactctcctttggtacccccatcctctacgataaggtcatcatcggagacatcatgccgctcgtccccggaatcgcgctcactacgtcgatccgcgacttttttaacggagattatctgtccggtgccattcacatgattgacgccatcctgaccgcattttgtatcgctgtcggcgtcggcaccgtcattacgatctatcattttgcaaggggaggtgcagcgctgttatgattatccagtttattgtgagtttgtttgccacactctcttttgcggaactgtttggcgcgccgaaaaaggaactgtttttctgcggtctgaccggtgccatcggctgggtcgtctatgtgatcggcttaaacagcaatatgggcacggtgcttgcgaatctgaccgccaccttcgcactcaccgtattttcgcgtattctgtccgcgatccgcagaaatccggtaaccgtttacctcatcgccggtatttttccgctggttcccggagcaggtatttactatacgtcctactatttcatcatgaacgatatgacgcaattctccaactatggcatggaaaccatcaaggtggcaggtgccatcgtgctgggaattgtctttggcttcggtctgccgcagagctggtttaacgcgctgcagcgaatagaaagaaaaaagacggctttgtaaaatccttacttacacagactgatatgctcccttacatctactgctctgcaatcttcgccgccagctcctccaggtactcccagcgctccatcttttcctcgagtgcctgttctgccgcttccttttccgccagaagttccccaagcttcaccgagttcgtggcgttttccgccatgtcggcatccagctgctccacttttgcttccaagttcgcaatgtcatcctcgatcgtctcgtattccctctgttccttataactgaatttcagcttcttctcacgtttccaggtgtttctggaatccgcctgctctgctgcatcctgcccggatgtcccggtcacaccgccggcctcctgtgcgctttccgcctccgagactccgcgtgctgtcattccctgaacttccgccgtttcgcccggctttctgccttcctccgccagtcggttgacataatctgtataaccgccttcatactgccggatctctccgtttccctcgaaagcaaaaatacgccgcaccacgcggtcgaggaaataccggtcatgcgataccacaatcacgattccctcatagctgtccaggtagtcttccagaatcgcaagggtctgcgtatccagatcgttcgtcggctcgtctaaaatcagtacattcggcgcctccatcagcacgcgcagcagatttaatctgcgccgctcaccgccggaaagctttccgatcggactgtactgctgcgctgccgggaacaaaaaacgctcaagcatgttcgatgccgagaccagaccgtcggtcgtccgcacatactccgccgtgttccggatataatcaatcactttttcctccgggtccatgtaggcaattcccgcttcgcggctcgtctcaatctcctgcgtatagtagccgatcttgatcgttgccccgactgtgatcgtgcctgcatccggtttgatgcgccccgcaatcatcttcatcagggtcgtcttgccgcttccgtttgcaccgatgaatccgatcctgtcccctttcagaaaaatataggaaaaatcccgcagcagcgtccgcccgtcatatcccttggtgatgtgatccagctcgatcgtggtttttcccattctggaatagacggaactcatctccacctggctgtcgcgctccggcgccttctgattcttcaattcttcatagcgctgcaagcgccccttctgcttggttgtgcgcgcttttgccccccgtctgacccattccagttccttccgcagtacagactgacgcttgcgctcactcgcctcggcgctctcctcccgctccgctttccgctccagatagccggaataattcgtctcatagctgtagattgcccccttgtccacctcgacaatacggttgcatacgctgtccagaaaatagcggtcatgcgtgatcatcaccagcgcaccgcgccattttttcagataattttccagccagtccgccattgccgaatccagatggttcgtcggctcgtctaaaatcagcacatcacacggcactaaaagtgctgccacaagtgccagacgttttctctgtccaccggaaagttctccggttttctgtgtaaaatcggtaatgccgaggcgcgtcatcatgctttttgcatcgctctcaaggctccatttctgttcctgtgcatgcgcgtctgcatcggtgcgctctgtcctcccgctgccgacaaaatttaagacacactgtgtcagcacactgtcaagtaccgtcatctccggatcgaacaccggattctgcggcaggtatcttaccacgatatggttggcgcaggtcacctggccttcatccggttcctccagccccgcaatgatttttaacagggtggactttcccgtcccgttgataccgattaccccgactttttctccctcctgcagataaaaggaagctttgtccaaaagcttcctctctgtgtatgatttcgttaaattctccgcgttaataatattcatgtctcttctctttctttcctgtttctgtatgactcaaatggctctcaccggccggcttccttctgcgtttctcctgaaacagccgcctgctacctatcgttttgcgctttctcctgaaacgtgcggatataccgcaggcactcctgttccggcagaggtctgccataatagtatccctgaatacattccaccccaagctgttccatcgcttcgctctgctcccgctcttcaattccctcgataatcagcggaatccccagctgtttgatggtatgaatctcattttcaagcacgatgcgcgccgccttgtcgtggaacgacgcccacacgatttccttgtcaatcttgatctcctggaatggaaaatggatcagataggaacagttcgcatttccgcttccgtaatcgtcgagcgcaaacgacactcccatttttcccagctcatgcatatgccacagcatccgctccggggcgccaatcgccgtgcgctccgtcacctccagcgtcagcatggacggcggaatatggtaactctcaagcaccggccggatggtctcggtcagattctggcgcagacactgcaccatcgaaatgttcacatggatggtgcggattccaagcgagccgttcgagagcacatgttttgagagaaaacggcaacactgctctagcacctgttccccgatatggatgatattgccgtcgcgctccgcaagcggaatgaattcctctggcgggatgaagcccagctccggatccttaagccgcaccagcgcttctaaggacacaatctgtcgttctttcagggaatataccggctgatagtagaccagaaatcccttctcccggatcgcccgcgccacggcaatctccacttttctgcggcggcggtactgtgcgatcatgtccgcgtccgcctccacgatgacctgcgcgccggactttccggcattttcaagcaggaactcccgcattccgtaatattccgccatcgccttaaagtccatcgggtagtgctgcaccaccgtctccatatccagcgcaatgcggttctcctgcaccacccagtcactttcaaaccgcttttgtatctcacattttaacctttcacactgctctttggtgtctgcaaacaccgtaaatgcatctcctgccgtgtgaaacacatgaaattttccacacagatcatacagatactccccgatctcgcgcagcagttcattgctgttctcggtacccagaatcgtgtggatatggtaaaacttgctcaaatgaatcgtgagcacatagccctcgccctttctgcggagccggtcctcaagctgcgattcaaatgccgtcccgtttccgattcccgtcgtcgtatccagaaacaccaccggattctgaatctgcagatagagcattatgagcacgaccgtattgctgacgctggtgcaaaggatctctctgtaccggtattgcagcccgatcatggcggctgccacagccgtgtaggcgcacacgatgaccttcgtgcgaagcgtggtatatttatgctgccgcacgacaatcagaagatccagcaaaaagaagatcacaatatacgcgtatccgtaatccgcgccgacgccctgataataactgccgtcactaaagtagtaaaaaaatccggtcaccggcgtcactgccaccagcacaagaaatgcggcaaacgggattatgcccgcagccgcaaataccgttctctccctgccgcggatcgcacatgccgccataaaataccggtaaaccagatatgacgaagccccctccagcacaaaaaaagcaaacgccagtacctcgttcagacgctgcggaacgagggctgcatttgctaatcccacacatgataaaatgttcatcagacactctgcttcacacacaaacagaagccagccgaatacccgtgtcttctccccgggaaactggcgcacgaatacaaagtgcagtaatataattgtcataattaagagtgatgcgatctcaaaatcataattatactgcacctgtatctccctcctgctcttcctgtgccgcctttgcctccagaattgcctcattgagctggagcatctttgcgtccagcatggacacgattcccgaacactcgcgcagatccctgctgatgtaatccggcgcatttccctcaaacttatagtagatcttgtgctcgaggctcgcccagaaatccatcgccatcgtccggatctgaatctccaccttcgtgtcgataatacagtccgacaaaaagatcggtaccgtcaccagcatgtgatagcttttatatccgctctccttgggatgtctgatatagtccttcacggagattaccgtgagatcattctgcttgccgatcatctcggcaaggcggtaaatatccgacgtaaaagaacagacaatccggattcccgcaatgtcattgatgtaattcaccatattgtcgatcgaggagtcatagccataccgcttcagctttttgacaatgctctccggcgctttgatgcgcgacttgatatattcaatcggattgtactgatgtacctgttgaaattcgtcatttaaaatctcgaccttcgttctcacttccttgagtgccgagttatacagaaaaataatggtgttccagctatctacgccttcacccagggttacttcccctaacgcaaccggcttgtccatgtgttcccctccagatgtctccccttatcatttattgcaatacgctccggcaaaagtccggaaaacctccggcttcccggactcgcgggcgcgtatttcgcagtacacgtccaagaaatcacagatttcttggactaccgggcagtcgccctatcaaaatcgtgccagcgaaaatgtgctctgcaagcaggcaatttttgctgttacgattttggcactgctcattgcttatgtacattataccatattccggggggattaggcaaatcgaaacacagcctgctgaaaccggttctttatttccttccataacttatgcagcttaatcctcctcgataacctgcatttccagaaaatcaaaatcaatctgctcgataaaggaatcctgcgtaaagcgcgtcttggcatggcacttgaattcattcacattcgcctccagccagatcggttttccgagatcaaattcatagcacacttcctcaagcgcatggaaaaccttgtgtgttcttgtctcatcggattcatccgtgatcgtcgtatcccgcagcaagtggttgttcttcatcatcttaaaccagattctcattttccgttccttctcctctgcctgttggtctcatacataagcaatgctgcggatactgccgcattcagggattccacacttccctccatcggtatccgcacgtaggtatctgccagccccgcgatctcatcggacaatccgttcccctcgttcccaatcagaaacgccgtccctttgcagtaggacggttcgtcatagtgcatctgtcccttcagatgcgccgcgtatatgccaaccttctgccgttttaattcaccgatcgtctctgccagatcgtccgcaatatagtagggtacccggtaaatgcttcccatcgtagagcggatggtctttggattaaacagatccaccgtcgtccggttcataatgatgccggtaattcccgcaccctcgccggtccgcagcatggttcccagattccccggatcctggatgctctcaacaatcagcagatgtgtcctgtccccgcgcaacagatcagaaagcggatactgcggcatacgcaccagacataagatcccctgcggcgtctgtgtgtcggaaatgctcttaaataccgcatctgcaacgacttcatagatctttccggcaagcagctgctccgcctccggttcctccagaaagcgctcggagacataaaccttagagagccactccggcggaacctcctcaaacatctttctgccttccacaacaaacaggttctggcttttgcgctcttttgcctttttcatcaatgccgtaatatttttcatctgctgattgctgctgctcgtaatcatgactgctcctttttgttccctaagcggaaaaaactccatgagttcccgcccatggagtcttatgatcgttccaaatactgttatgtatcttacattgaaagattcttgctgatctgatactgatactccggaatgcatttctgcattgcaagtgccgcatcgatgtcgtcatccacgaaatcgccgtgacgataaccaacgacacggttgctcttgccctcgcagagcagatccactgccagcgcacccatcgtggatgcatagacacgatccttacaggtcgggcttcctccacgctgcatgtgacccagaatcgtcgcacgcgtctcaacgccggttgcagcctcgatacgcttcgccatacttgcagaatgtccgataccctcagcattgacaataatgtgatgctgtttgccgcgtttacggttctcgatgatatggtttacaatcttctgctcatcgtaatcatacttctccggaagcagaatatcctctgcgccgttcgcaataccgcaccataatgcaatataacctgcaccgcgacccataacctcgatgatgctgcagcgctcatgagaagtagaggtatcacgtaccttgtcgatcgcttccattgcggtgttcaccgctgtatcaaaaccgatggtatactctgtacatgcaatatcaaggtcaatcgttcccggaagaccgatcgtgttgataccgagtgccgccagcttctgcgcacctctgaaagatccgtcaccgccgataacgataattccgtcgattccatgcttcttgcagatctctgctgctctctgctgaccttccggtgtcttgaactccatgcagcgtgctgtctgtaaaatagtaccaccgcgctggatgatatcggaaacgtcttttgcttccatatccacaatctcttcctgaagaagtcctgcataacctctcttgattcccttgactttcttacccttggcaatggcttccctaaccactgcacggattgctgcgttcatacccggggcatcgccgccgctcgtgagtacaccaatggtgtttatctctttcgccatttatcgttccctcctcatataatatacccatttaatctaccttattttaatctctttatggcttcttttcaatgctctttttgacaacttttacgttattttcccccaaaaacttagttaaattgttcacaatctccggttcgatgcagatactgtagttttcgggcagccgcttcatcgccttgaccgatgaaatatagatcaccaccgtgtctttcccatccgaatcatggagcatggcatagagttctttttccttttccgcaaacgcttccttggtctcaaactgaagccataattcatcgccgcgccgcgcgggaacctgcgcggctgcaccgccacggcttgatccgccgtctcccgcggatgccggactgctgcccgcattcccgcctgcaccgcgccggtatcctccgccctgccggtaagtgcgctgttcctgtggcattccgttctctgcctgttcaaacgtacagatctgctcgcagacgatcttggcgtttttatcctcctccacgttggcatgtccgcggataaataccttctcatcctcattcagcagcgtatgatagcgctcatactcgccagggaatacgattacctccaccgtgccgaacagatcctcgagcgtgagaaatgccatcgtcttattattcttcgtatatttgatggtcttctccgtaatcattccgccgatgataaccttctggttatcccgtagcttgacctcgccgctctcctcgtccagcaggaaatccgacgtcactgccgatatgattctgcgccatttttcctcgtattcctccagcggatggccggtcagatagataccgatgacttccttttcaaagccaagcttgatctccttgctgtactctccaacgttgggatactgaatctcataggcttttttctcctcctccgacaccagatcaaacaggctcatctgtcccgccagcgacttctttttcgtctgcacctgctgatccatcagagcgttgtacaccatcatcatctgctgtctgttaccgtctaaggtatcgcaggcaccggatttgatgagattttcgacggtgcgcttgtttacctcagagtccgccacccgctcaataaaattctgcagggtacggtagggaccgttctgattccgctccgctatgatcgcatccaccaccgaacgcccgatactcttgatcgcatacagtccgtagcggatgccgtctttcgtcgccgaaaaacgtccctcgccctcattgatatccggggccagcactttgatgcccatctgtctgcaggtatagatatactccgccaccttccgcgggttatcaatcacggaggtcatcagcgccgccataaattccaccggataataatatttcagatacgccgtctgatatgcgaccaccgcgtatgccgccgcatgggatttgttgaatgcgtacttcgcaaaatccaccatggaatcgtagatctcattcgccgccttctcactgataccgtttacaatacagcctttgatcccctgctcctcatttccgtaaacgaaattgtggcgctccgcatcaatgacatactgctttttcttactcatcgcacggcggatgttatccgcctgtcccatggaatagccggcaagattctgcacgatctgcatgacctgctcctggtagacaatacagccatatgtcggctccaggatcggttccagttccttgcaggtgtatgtgatgctctccggctcgttttttcccttaatgtactttggaatgaaatccatcggtcccggacggtacagagagattccggcgataacatcctccagactctgcggttttaactccttcatgaagttcttcatcccggcactttcaagctggaagacgccctcgcattttccggttccaatcgcatccagcaccttcttgtcgccataatcaatctggatcgcatccggatcgctgttgtcattataatcgatgtgatcgacgtcgatccgcacaccgtgattcttctccacaagggcaacggcatctttgattacggtaagcgtccgaagtccgaggaagtccatttttaacagaccgagttcctcgatcgttgtcatgacgaactgcgtggtaatcgtgccgtctgaagctctggaaagcggtacatactcatccatcgccttctgtgaaatcacgacacccgccgcatgcatggacgtatggcgcggcagtccttccagacgttttgccatatcgatgagtgtatgcaccgtgtcatccgtctcgtacatggtgcgcagctccggattcatggtaagcgccttatcgatggtgatgttcagttcgtttggaatgttcttcgcaatcgtatcacagaaattgtacggcagatccatcacacgccccacatcgcggatgactccgcgcgcagccagcgtaccgaatgtgacgatctgcgtcacgcagtccttgccgtatttcccgattacatagtcaatgacctcacttcgtctctcatagcagaaatcaatatcaatatccggcatcgtgacacgctccggatttaaaaaacgctcaaacagaagattataccggatcggatcaatattggtgataccggtcgtgtaggagacaagacttcccgccgcgcttccacgccccggtccgaccgggatgccatgcgttctggcataattgataaaatcccacacgatcaggaagtaatcgacatatcccatcttctgaataacggaaagctcataatcaagctgcggcagcagctcgtcatggcggtccggataacgctggatcagtccctcatgacacaatttgttcagatacgtccaggaatcatacccgtccggcactgtaaagtgcggcagcttcgtcacgccgaattcaatctccacatgacaccggtctgcaatcttctgggtattctcgattgcctgcgcggcatagggaaaaagtgcgcgcatctcctcctcggatttgacataatactgtccgccctcatagcgcatccggttctcatcggacaactttttccctgtctgcaggcacagcaggatatcatgtgcctcccagtcctccgcataggtatagtgcacgtcgttggtggcgacaagttcaataccaagttcctggctaagccgcatcagaccggcattcactgtcttctgatccggaattccgtgatcctgcagttccaggaaataattgcccttaccgaagcatgcctcatagcgctgcgccgtcttcttcgcctcatcataaagacctctgacaagataacgctgcacctcacctgccagacaggcactcaacgcaatcagcccctcatgatactgttctaaaagttccatatcgacacgcggtttatagtagtatccctccacaaatcccttcgatacaatcttcatgagattctgatacccctggttattctccgccaacagcactaggtgataatagcgatcctccccatgggacatctcccggtcaaatctggagttcggtgccacgtagacctcgcatcccaaaaccggattgatccctgccttcttcgcttccttataaaaatcaatcacgccgaacatgacaccgtgatccgtgatggctcccgctgtcatgccaagttccttgattcgttttacatattctttgattttattggaaccgtccagcagactgtactctgtatggacgtgtaaatgtgcaaatgacataataaatcctccgttttttcattatattatgaacaacggaattattcaaatcttttcacggatcattcccgtgctttcccatatcagaaatagatagacacgtcccgaaattgtttggttgataatagcggcagacccgccgcttaagaatgagacagactcgtctctacattccagacaggaactcttccacagttgttgagcgcgcagcaagtttcagccacttttccagtgtctcatcatcctgttctcctgcgatgcgctgctgctcttctgccggaatagttccaagttcggctgctaatgacaatatactctgtgctacttttgacgctgcaagtgactccgcaagcggcttcgcaagcgactccgcaagcggctccgccatcgactccgcaagcgtctccgccatcgactccgcaagcgtctccgccattgactctgccattggcttcgcgagcgtctctgccattgattccgctatcgaaggtgccatcagctttgcccttcgctccgcttcctcacggatatactcttccatcgtcatatagcctgcctccaattttcgatcacgttttagatatttgactctctcatgaatattacggattttttcatccggatgcatacacatcgaaacgcacactcttaaaatcgctgtcaagaaacagtgtgtgctccgcatgcgccttcacgcgtggaatctccttattcaggacaatctccagcagatttctgcagatctcctcgtcctgcagggctgctgcaaacaaatatgcattggtcagattcagtttctgaaaactttctcccatatacaagtacctcctctgtgggaagtgcctgcctgtaaaatattataaatcattcttacgtcaaatgtctattggtcgaaatcacgaatttccagatcaggtttctggatatcgactatctcaggatgcatttctttcttttttgtgttataatgcgttgcacaaatgtaacagaagggatcttgatctacatgggaaaaacaggactgattgtcgagggtggcggtatgaaatgcgcttacagcgccggtattctggacaagtttttagatgattctatcgcattcgactattgtatcggcgtctctgccggagctgccaacaccctctcctaccttgccggccagcgcggcagaaatctgcgcttctatactgtacaccttgacgatccgcgctatctttccgtccgcagcctgcttcggaccgggaatctgttcggtctccagtatatctacggaacgctgaccaactcggacggtgccgacccgattgactacgatgccatcatgaaaaatccggctgaattttatatgccggcaacggatgccctcacaggaaaggcagcctatttttccaagttcgacatcgtgcgcgacgactaccgcaccatcatggcgacctgcgcgcttcctgcgttctgccgcccggtcaatgtgaacggacatttctactacgacggcggtgttgccgattctatcccggtacaccatgccttagaacacggctgcgacaaggttgtcatcatcctgtcaaatccgcgcgatttcgtgaagcagccggaggcacaccggccgatctacaagcgcatgctgcgcagatatcccaagaccatcgaagggatcgaccaccgccatatcaattatcaggcttcgattaatctttccaaccggttagaaaaagagggccgtgccttaatctttgcgccgagccgccatctgccgctaggcactttttccaaaaatgcagccttggaacagcagctttacgacctgggcgtatccgattatgaggcaaaacgcgctgccctgcaggagtttttaaaggcgcagggtcactcataggttttctttaaaaatgcctctgccccctcctgtgttttttccatgaattcccctatatccgtccagcggagcagaagtgtatcttccgtatagccctgcttcttaaaataagtttgggcatactgttgatacgcctcctctgtcagcgggtttccgtccgcatccttacagacaatctgcgcctccccttcatcaccgctgttccccgccacatacagccatgacatggttgccagagtctccaccttaatctcatcctccaaaacagacatggcgtctgtcgcatagagatgctccgctggcgaaaccctcaaatcatcatacacaatataatattcctgcaaagtttctttcgtttctttccgatacacggtaagctcatccgcaatcaaatccggttgggaatccccctctacaaaagacgtcttcagttcctttaacgtgccattctcctccaccctgtaaaacctgctgtacgtatagattccggttcccccacagttcgatacaatcagctccagtctgccatcgtgatcaagatctgctatcgcaaactgatacatctcatctgcgtaatctggatcattcacccactgattccttgtccgcgcaatgacggcaagctgatcgtccgcatcctccacatcggaattttctgtctgctcttccgcctgtgcaatactttgtatcttctctgtctcatctgaggaatttaactgagcttccttcgtctctcgctccgtctctcccatcccgtctgcgtgcggtaaagccgtcccgcacccggcagttatcgcacagataagcattcctgctatcatgatcttcctgtttttcatcgctcctgtcccacttttgaaaaatacatcggtatctatccttttaaaatatgtagtatctgttttattttaatgacttcacaggcatttttcaatctttcgtttcactcaagaacaacgtgtgcgcttgccgcacacttgcgcatcctcgcggagcgtttttgtgtaataggaacgaagttccctattacacaaaaaaaggggcggaggctttctgcctccgtccctcttctctgttcctgttttagatcaaccctcacgctttcactgctgccgtcagttcatttccggagacatcaatcagaatcgtatctccctccctgactttatccgcaagaatcagctttgcggaaagtgtctccacatgcttctgtaagaaccgctttaacggtcttgcaccgtagatcggatcatatccgttttccacgatatactgctttgccgcatcggtcagttccaccgtgatctcacggtctgccagacgtttgttgagatctgcaaccagaaggttgatgatgttaccgatgttgtccttcgtcagcggcttaaacataataatctcatccagacggttcaaaaactccggacggaaatgtccgcgcagttcgtccataactgccgcttcgcactccggattgatatccccgtttgcatcgatgccctcaagcagatgtgctgatccaaggttcgatgtcatgatgatgattgtattcttaaaatcgacggtacgtccctgtgaatctgtgattcgtccatcgtccagtacctgcaacagaacgttgaacacatccggatgtgccttctccacctcatcaaacaataccaccgaatacggctttctgcgcactgcctcggtcagctgtccaccctcatcgtatccgacatatcctggaggcgctccgatcagacgggagacggaatatttctccatatactcactcatatcaagacgcaccatattcgactcatcatcgaagagacttgctgcaagcgcctttgcaagctctgtcttaccaacaccggtcggtcctaagaacaggaatgatccgatcggcttactcgggtctttgatacctgctttggaacggatgattgcttccgtcactttcgtgacgccctcatcctggccgatgacacgtttgtgcagttcctcgtcgagatgcagcgtcttgttacgctcgctctccgtcagctttgccaccggaattcctgtccatctggagatgatccgcgcaatctcttcctcactgacgttttcatgcaccagggaaaggtcgcgtttcttcacggcttcctcctcgatctccaactgcttctgtagctgtggcagcttgccgtactgcaattcggctgccttctccagatcgtacttctgctgtgccatcttgatctcattcttgaccgcttcgatctcctcacgcagcttctgtactttttctaccgactttttctcattctcccactgcgctttcttcgtgttgaattcatcgcgcagctctgccagttctttctgcagatttgccagacgctcctggctcagacggtcggtctcctttttcagcgctgtctcctcaatctccatctgcatgacacggcggttcaactcgtccagttccgtcggcatggaatccagctcggtcttgatcagcgcgcacgcctcatcgaccagatcgatcgctttatctggaagaaaacgatccgaaatataacggttggagagcactgctgccgataccagcgcagaatctgtaatcttaactccatggaaaacctcgtagcgctccttcaatccacgcaaaatggagatggtatcctcgaccgtcggctcatccaccattaccggctggaaacgacgctcgagcgccgcatctttttcaatgtattcgcggtactcatccagggtcgtcgcaccgatacaatgcagttcaccacgcgcaagcatcggctttaacagctgtccggcatccatcgcaccatccgtcttgcccgcacccacgatcgtgtgaagctcatcaatgaacaggataatctgtccctcggaacttttcacctcatcaagcactgcctttaaccgctcctcgaattcaccgcggtattttgcacctgcgattaacgcacccatatccagtgcaaacaatttcttgtcctttaagccctccggcacatcgccttttacaattcgctgggcaagcccctcgacaacagccgtcttgccgacacccggctcaccgatcagcaccgggttgtttttcgtcttacgggacagaatccgcacgacattccggatctcatcatcacgtccgatgaccggatccagcttctggtctctcgcacgggctaccatatcatacccgtacttctccagcgtgtcgtaggttgcttccggattgtccgatgtcacgcgctgattgccgcggactgtcgagagcgcctgcaaaaaccgttctctggtaatgccgtactccttaaagatctccttcaatgccttattcggatacttgatcagcgccaggaacagatgctcgacagaaacatactcgtcccccatctgcttcgcctcatcctcggcatgaatgagcaccttatttaaatcctgtccgacatagacctgaccgccagacaccttgacacgcgctgccagatgccgctcggcgttatccatgaagtgctccttctgaatctccatcttctcaatcagcttcggaatcagtccatcctcctgccgcatgagtgcaaccagaagatgctcctgctcgatctcctgatttccatattcataggcaagcttctcgcaatcgttaatggcttccactgacttttgtgtaaatttctgaatgttcataagcgtacctctctttctcttcctatgatatacaggcggcacatatctatgcgccgcctgctttgttctccctgttacaattatgttatagcaccagttgttagcactgtcaagaggtgagtgctaattttttcagataattttaccgccagcagaagcagggacttcctgcctaatatggtctgctctccaacagctccgagagatccatctcacagtcaaaatatgtctcctccacatactggatcttctccacgctttcccccgcctccaggcggcggatcgtctcctccacaagcggggctgtcagcggattgcattcaaaatcagccgcgatgtccccggtctggattgccttgagggcatcccttaccgcatcaaaggacaggataataatgtccccgtcactgccaatcgtcctgcccgcctcccggatcgcctcgatagcgccaaaggtcatattgtcattctcgctgattacaacatcaatatcctcgtatttttcgagaaattccttcataacctcctgcccctttgcctgcgtgaaatcccccgactggcgctccagcatcacccagttttcattctgctggagaacctctgcgaatccgtctgtccgcccgatctgtgcagaggagcccagcgtcccctggagagatacgatatgaactgtctccccgctccgcccctgcttttccagataattctccagccagtgcccggcgttcctgccctcctccgcgaagtcactgcccacccagcatgtatacaggctgtcgtcctccatctccgccctgcggtcagacagaatcaccgggattccggcttccttcgcctcctccagaacggattcccagcctgtctccacgatcgggtcgagcacgatataatccacctcctgcaggatcagattgcggattgccttcacctggttctcctgcttctgctgtccgtcctcgaagatcagatagtagccgttttcctgcgtgaacacatccttaaaggactgtgtgttggtggttctccagtcggattccgagccgacctgcacatatccgaccacaatatagccgtcctgctgcatcgtctgctccgtatccagctgtcccgcagtctctctctgctccccactcccacagccggctgtaaagagcagctggctggcaagcagcgccgccgcgattcctttttttcccacagtcctcttctgaaatatgttcatattcctcccgccttttctcctgccggctgcacctcctgcccggggtgcttttttaacgcagcacggtattttcccatagaggagccaaaaggctgccgcatgaagtggacagcccctggacagccttgtttttatttgctcttctctttgatctttgcaaagatactctgtaatacgatgaagaagcagagcagcgcagccaccgcaatgttggaccacgagctgagcagcttgccgttcgtcttcaccagtgtggaaatcgttccgttgataagtacaccaaagaaggagccgatgacatttcccacaccgcctgtcaataatgtaccgccgataacggaggaagcaatggcatccatctcaagtccgagtgcctgctgcacatttcccgacatcgtgttcaggcagtagcagatgccaccgatcgagcagaggaatgaggaaagcacatacgccttcagcttcgtcttcttcacgtccagtcccatcatggtcgccgactgctcacttcctccgactgcgtaaaggcttctgccgaacttggtatagcggagcatgaaaaatacggctatcagcacgagcagcgccacgattaccgatacacggataaacggaacctgcaccacgcccttgttgttggtataggagccaaacggaaggctgatcttcgtattggcaagctttacaaaaaatgcattgctgctgatggagatctgttccgtgctgatcacggctgtcatgcctctggcgaagaacattcccgccattgtcacaatgaacggctggatattcagatagccgacacagaagccctgcaccacgccgaacacaatcccgatggcaagcacaagtatgcagagcagaaccgcattcatgttccagcgctccatgccgacggcaagaatcatgcagtccatggcaaccagcgagccaacggaaatatcgatgccgccggtcagcatcacgcaggtcattccacaggtgatgcagagcaggcccgcattattgataaggatgttcaaaaacgtctgcagatgtgtgaagcccttattggaataaatcacacagcccacggcatacatcacaaaaaataacgcgatggtaattatcagaagaaccgtatttccatttaattttttcgctttcattatgcagcacctcctttggcaagctgtctccttacagacatttttttcataaatgccttaaacggaggtgcctggattgccacaataatgataacaatgaccgccttgtacaccggtgcctgctcggtcgagatgccgagcgcatacagggtggtggtgatcgcctggatggtgtacgcaccgataatagagcctgccagccggaactttccgccgccgaggctgttgccgccgagtgcaactgccagaatcgcatccagctcgaagttcagtccgatgttgttggaatccgcagagctgatccgggaggaagcaacaatgccggcaattcctgcacacaatccgcagacaacatagcacaggaaaatgatgcgctcggaattgatgcccgcgatgcgggaagccttcttattgatgccgacgctctggatatataagcccagtgcggtcttgcggagcaccagcgatgtgatcaggatgcacacgatggcaaccacgatcggtgtcggcataaatccgagatagccgccgaagattttaaaggaatcatcccggacgtatacgatcatgttgttgcagagcagaagtccgattgccctcgccgccgaaaacaggatcagcgttgccaccatcggctgcacattcagatacgataccagaaaaccgttaaacgcaccgctggcacatcccatcaggatgccgccaagcacaccgacgatcagcggcgctgcaaggctgttggtggaggacacgccgtagcctgccagaagcatgcagcagaacgatgccgccagtgacatgaccgagccgacggaaatatccgttcctgccgagcaggacacaaccagcgtcatgccgatggcaagaatggcaatctcactgccgcggtttaaaatatcaatgatgcgtccgtacaataccccgttgcggatggagatggtaaaaaagttaaatgcaaaatttcctgccatcacatcatagatgatatttaccgccatcaccagtatcatacagaaaatcggtaaaaacaacggctggctgaccagcttcttaaacttactcattcctgccacctcctgctatggactgcattacatgcccctgggtcagttcctcagtgatctctcccacttcctgaccatcccttaataccaccagcttggagcatgttctgagcatctcctcaatctcggaagagatgaagatcagactctttccctgatccgcaagctcgatcacaagcttctggatctcagtctttgtcccgacatcgatacctctggtcggctcatccagaataaggaattccggatctgtggcaagccagcgtgccagaatcaccttctgctggtttccgccggagagctgcccgatcagggtctccctgctcgccgtcttgatctgcagcagctcgatatacttgtctgcgatctcgttctgtctgctcattggaagcagcttaaacattccgcgctttgcctgcattgccagaattatattttctcgtacagataagtctgcgataatgccctctgcctttctgtcgtccggaagaagtcccattccaagattcatcgcatcaatcggcgcattgatctttgcctcttttccgttgacaaacagcttacctgtctggtttttatccgctccatagatgacacgcgccagctcactgcgtcccgagccaagcagacctgtcagtcccacgacctcacccttatgtatctgtaaatcaaacggcttgatctttcccttgtggctcatgccctgcgcatcgataaccaccggcacattggtgaaatccttcttctcttctgattttacagctgcaaggtcatcaaaatccttgcccatcatcgctgcaaccagctttacccttggcagctcctcaatcggatattctccgaccagtatgccgttccggagcactgtgatccggtcacagactgcgtatacctgctccagaaagtgtgtcacaaacacaatcgccacacccttttccttcagctgccgcataagaacgaacagcttttcaacctcatggtcatccagggaggatgtcggctcgtctaaaatcagtaccttacaatccatatccaccgctcttgcaatcgcaatcatctgctggagcgccagtgaatactcttccagatttttggttacgtcaatatcaagatccaggctcttaataatcctgttggattttgctgtcatcgtcttccagtcgatggttccaagctttgtcttcggctccctgccgataaataaattttctgccacactcaaattcgggcaaagattgacttcctgatacaccgtggatatgccctttttctgtgcatccagggtcgaatgattgaccaccggttcatcgatcccgtcaacgcgtatttctcccgcatcgaacgcgttgattccggtcagacacttgatcagtgtagatttcccggcaccattttctcccatcagtgccatgatctcgcccttccgcagtgtaagatccacattgtccagtgcctttacgcccggaaatgtcatggtaatcccccgcatggtcagtaccacattatgctccattttactccaccctttccttaaaattgggagagaccaacgggcctcccccattacaaattccctgtctgtgaagcagcttcttctctgtccctgctataatgtttgtcctgttgccagaccgtcttaatactgtgcgtcaacgatctcctgtgtaaccacggtaagctcctgctcctcgccgtttaccgtgatggatgaaaggatgtcctcatttacataccagtgctcaaccatgtatacttccttgtcaggtgtgctgccggactctaactgctggataacatcctctacaaacggagctgcaagcgggttgcactcgaagtctgcattgatgtcgccggacattacatactcaagacctgcggtgcaggcatcgaaggaaatcaggatcacgtctccgtccacaccataggagatacctgctgccttcatggcatccatcgcaccaaatgcctcgttatcgttctggcataccactacattgaactgtccctcgtagctcttgatgtaagactccataacctcctgtccaccagcctgtgtgaaatcaccggtctgggaatccagaatgttccagccgtttgcatctgcgatctccttgaagccgtccgtacgtccgatctgtgcggaagcaccggttgttccctcgataacgagcacgttcacgtcgctgatgccctttgcatccgtgtaagcctttaaccactcacctgctgcaagaccctcattcttgaagttggagcctacccatgaaatatatttgtccgaatcatcaatcgtacggtcaatgacgataaccggaatacctgcctcctcgcactctgtcagtaccgtgtcccagcctgtcgatacgatcgggtcgatgatgatgtaatccacatcctgctcgatgaagccacgtactgcctccagctggactgccgaatcctggtcgcagtcaacgaactggagatcatatccgttctctgccgagaagatggactgtgcggaattcgtggatgcggtacgccagtcagactcatggccaacctgtgcaaagccgattttgattacatccccgtcagctgcgtctgccgcatctgctgcgtcagaagcatccgctgcttcgctgtccgctgccgtatctgcgtctgctgcatctgctgccgttgtgttgctgctgtcagcagcctcctcgcttccgcagcctgccagtaaggttgcgcccattgccatgcacatcagtacactcactaacttttttttcattttaaaaacctcccaaagtttttattagatttggttaagtccttaaccatgtacctattatagctttcggacggtttaaaaaataccgactggcttttgaaataagtaaaattttttactaaattatgaacagctcattcacaattttgccgtattttcctcaaaaggtgtaatttttttggaaatgttgcgttttcttttgattttctctgcccggcacggaatccgcacccagatctcggtgccctgcccgtaggtgctctgtatcttcagtccgtactccctgccataattgagctggatacgctggttgacattgaacagtccgaagccgcccgtctcctcctgctccggctcctgctccccgtcgcggagcatggcgcacacctgcgcaagccgcgcaccgtccattccgattccgtcatcctgcaccttgaaaatcatgacatcctggcagagtacaccggacacccggatatgtccgccgccgcgcttgttcttgatgccgtggtagagcgcattctccacaagcggctggagcgtcagcttgatgatctcatattcatagagctcctccggaatcgcaatctcatattccagtatatccctgtagcggaactgctggatctctaagtagctgcggatgtgctgctcctcctcctttaccgtgatgaactcccgccccttgcttaaggttgtccgaaaaaagcttgacagggacgacaccatcctcacgacctgctccgtgtccttcgactccgcgagccagatgatgttgtccagtgtattgtacagaaaatgcgggttgatctgctcctgcagcacgcgcagctccgccgcgcgcagattcagctcctccacgcgtatatcctccacgagatgcccgatctcctccaccatctggttaaagctgctgttcagaaccgagagctcatccagctcctcgtcctgcgcccggatcgcaaaatccccgcttcccgctgcctgcgcagcctcacacagccgctggatgggctccgtgatgccccgcacaatcctcctgctgaccatccatgccccgagcagtatcaggacgagaatcactgtgatcgccgtgatggcactctccacatccgcgcggattcccatccgcagctcctccatgttcgttgtctcatagtagatataatactggatctgctcctgtatcagctccgtcaggacgcggatattcagatccagacgctccatgttcgtctcataaagcccggtcacaagcgcatccttctcgatctcctccacacgatcctccagcgtgtcaagactctttagtatgcttgacagccggttcgcggcgtactcggaatctgcctcctcatagagctcgccgaacacctcccgcgcggcctgtatcatccggtgcggctgctccgtgtccaccagctcctcggcacgctccgaattgactacgataatatacatcacgtagtccatgtcctccttgaaattgatgttgtacgcgtttgcctttgtgattctcctgacaatcccgtcatactcggaggaaatcttgttcgtcataatcagaagatacgccagaagtatggtcagcggcaccacacagatcagcagcagcatatagagcctgctctttagtgaaaaccctctcttcaatatccatctccccttttaccctctgctgcggtactcacccggtgtgcagccctgcgtcttcttgaacaggttgctgaaataatgcgcatcccggtagcccacctcaaaggcaatctccgttaccttctttcccgtcgtcctgagcagctccttcgctttttccatgcggattcttgtaagatattctacgaacgtctctcccatttcctgaccgaataccgtgctgaaatggctcggactcagatttacctccgctgcgaccatattcagggaaatcccgtccttctcaaaatgatcgttgatgtaggtctttgccttctgcatgatgccgtcgtattttccgtccaccgcctcactgcgcaaatccagcaccgccgaaaaaagcttcttaatatattccctggtctgctcaaccgtggtcaggtaggctgccatctccttcgcatcgccgcaccgctccacgagatccctgctcttgtaaccgctcttctccagaacggaaaccgccgtcacatacagatccatcaccacgtactggcgcaggaagatagactttacattgccgtccccgagctgtgcaaagtaatcctccacgaagccggacacctcctccctagtgcccgtgtacagaaaagcctctgcctgccgctgactcaggctggagatattcagctccccgagctttacatcctccagaacctccgccgcagtctcccccggcgtctcctcctcaaggatctggttgcgctctaccgaatagcgtctggaaaagcacaggttggtctgccggtagcactgctgcagctcgctgaaacgctccaccggtgtcccgagcgccgcgacatactccaccgccgtctctctccggaaatactctgccagcaggctttttacctgctctgtcgtctccgcgagagactgctgccctgtgcccttcagcacaaaatcgtactccgcccggccctgctttgcgacaatcagattgccggactgctccatgtacttctccagctcctgctcgaaggcttttatcttctccggcaggacatcctccttctcctcggagaacagctggagcatcatgatattgtactgctccgcaatcagctcaagtcccagttccttcgcctcctggaacaccgacgcataggtatgctttccggagaccatgtgccggaacagccgctgcctgccggcagatctcacctcctccggcgtctgctgcttctgcttcccgcgctcctcctcgatcttctgaccgatcttcttgagtgtcccgatcagctgtgcacccgtgaccggcttcaccagataatccgtgattccgatgtcgattgcctcttttgcatactggaactcgtcatacccgctcaggagtatgatcttggtctccggcagctcgtgcttcacgagacggctcagctccagtccatccatgaacggcatcttaatgtccgtgatcagaatatccggtctcgtcttctggatgatcggataggcgagctccccgtcgcccgcgtcaccgacaaattcaaagccttcaccctgccagtcgatgttgttctttatgccctcccgcataacgatctcatcttccgctaaaaaaacctttaacatatgaaattcccctcaatacattttcctgtaaaaaccattgtaaattcattttatcacacctgcgaacaaaaaacacagaagattttggctgtccgggatgcctatcaccggattctgctcgatgcagtcgataccctcgtgcagaaatgtccccccgcatacgcaggacttccggcgctcagggaacgcatctatttaggtatccagcttctggaaagctttgcgcacacccagctggagacttccctctgcagtcagtttgatatggaatccatgcagacactctgcctccggattgcagtggagctgctgacaccgccgcatcagacgggatccgatacggcagtgtcatgttcacactaatcttatgaaaacgccctgcggtcttaagcttccgtgctccaatccgttcgcgaacaggcagtcctccggctccggcagtccccgctcccctgtccgcaccggttcctccccggcgttaatgcagacctccagcgttttttgtccttcttttttcttataataatgtaacaatctggaatcctctctgacatcccacatcacgttcccgctccttgtctgcggatactgcctgcgcatcgcaatcagccgctttacctgtccggtcagctccgcaaagctacccgcatcgatctcctcccacggcatgcacttccggttcgcctttgttccgcctccgtccatgccgatctcggtgccgtagtagatacccggcgcgccctgcatggtgaacagaatcgcaagctgtgccagaaacgtatccgcattaccgtgacatctctccatcagacgatccgtatcatgggaatctaacagattaaacagcacccggttcacctgctcgtagtacatgctgtaacactggttaatgccatgcataaaatccattccgctctgtaccgcatctgcccagaagttattcacacacgccagaaacggatagttcatcgtcgaatcatactcgtcgccgagcagccacgggaaagaatcgtgccagatctcgccgagcaggaaaagctttggattgcactttttcaattccagacgcagatgttttaaaaatgcatgtgaaatctcattgccgacatcaaaacggattccgtcaaccttccagtcacatacccagtgcttcgcaatgccggtcagatactccatcacatccggctcgctggtatcaaattttggcatattgtcgacaaacgcaaacgaaaaataatccccccgcttcgtcgcatgggtccgctcatcgatcggccagcggttcacgcagaaccagtgataatagtcggactgcggtcccttttccagcacgtcctgccagagcgcgcacttcgctccgcaatgattaaataccgcatcgatcatcacgcgaagtccgagcgcatgcgcctccgtaatcaacgccttcagttcttcctccgtgccgatatccggctccacgctgtggtagtcgatcgtgtcgtaccggtggttggaatccgaccacagaatcggatttaagtaaatacctccgacgccgaggtctgcaatataggcaaggcggctgcggattcccgccagatcacccccgtaaaactccttccatgttgcatcctcctgacaagcccattcccggcaggaatgacgcttttctcctggattttttctgcagaaacgatccgggaaaatctgataccacacgatattctccgcccattccggcaccttcataatgtccgcccggttcatccacggatagataaaacgctggatcatccggtccgctggaaagcgctctgccgctttcacaaatccatcctcatacaggcagacgctctccccgccgccggtgatctcaaaatggtacttgactctgcggtacaccggtgtgaggacggcactatatacatttctgtgcgccagttcccgctccagttccatcggcacccgctcgccctgccagttctgctcgttctcggcaatcccggcggaatacgggtcgcccgcccagaggatcacctcgtccacatcttttcctgtctgaatacttatttttaaatgtctctcatcaagcggatagcagtctaaaaaatacgcccgatgtgtaatttctgccagattcatagttttccccctgtacaaatttgctgcagatctcctgtcagctgctccgggaactccggatttctattctacgcacagtatatctctgcgaggggaatttttctcacactatcaatcgcgtaacctgtacaaaacaatcattttttctttcacttctatcacagcatccggccggaaagcagttcgcttccctcttcgtaatccaggttctcatatgccgcatgcagttctgtcaacagttcccgttcctccgctgtcagatgggcacgcgcaaaccgggaaagtccctgctcaatcccgtttaaatcacacgcatcaaaagcttccctaagctgcgccagaatctgctgcttttcctccggtatgtcctctgccgtggctgcgccttccccctgtatctcctgcggcagattctttaattcatcctcgacactctctaacgtgtgccggatcgtctccaaaaactctgtcatatgcttttccatgtatcggatattttctgtctttgccgccatttccatgatttctgcgctctcgcttaacgcctgtctgccgatctgctggctggcgcccttgattccgtgcactttcgttccgaaaagctccagctgctccggcacatagcccggcagttctgctgcaagcgatcccgtctcctgcaaaaacgtctgcaagagacggcggtatgccccatggttcatctgcgcgtgaagcaggaaatccctgcgctctgcgacaggcagataagtctcaatcactttctttagctctgacacatcgatcggcttgtccagatacgccgtaaattccggtctgcgattccgatgctttaactccgcggtaatatcagcagtcataagtaccattgggatatcgcaaaactggcggatctccttcgccgcttcatcgccatttttttccggcatcctctgatccagaaaaatcagctgatactccttccgcgctgccgcctccacagcctcctttccgttgcgcacaacatccagtgtaaaccgccacggcgctgcgagttcctggaaaatctcctgattgatccgcatatcatccgcgagcagaacatgtgcccccggatagatccatgtcggctggatccgctccgtatagaccactgactcgcgcagcagactgtccgtcgtatagcacaccgcatcatgcagggtgcttccgcacaccttctgccggatttccacggtaatcgtggttcccctggtgccgttgctctcggcgcggacactgcctcccatacggtttgcaagttcctttacaatgctaagtcccagtccgtttcccgactgtccgctctctgccgcatagctcacataagaatcaaatccctgccgcagctgttcgcttgtcattccggtgccggtgtccgacaccctgcagcggaccatcacatccgaggaatcccggattgcctcacaggtaatcacacagcggatctcgccctcctctgtgaacttgaccgcatttgcgagcagattctgcaaaatttcccggacgcgcatggcatccccatacattttctccgggaattctccctgtatacaggcctcaaaccacaccctcttcgactgcagattgatgacacacatgtgtgccacctcctcgagcacctgatccagccggtagcactccgccatcagctcgaactttcctgcctcaattctggaatagtcaagaatcgcattcacctgttccacaaggctgttcccagctcccttgatgtgaagcaggagtgcacggtcacttgccgtgagttccttgcggctgcttaaaatatccgtgattccgatgatggcgtgcagcgggcttttcaggtcatggctcatctgcgcgaggaaatcacttttccgcgccgtctgcatctctgcttttccctttaatgcctgcatcaactgcgtctcttttttcgggctggtaatatcccaggcaccgagaatatatccacgaagcctccctgaatagtacaccggcgtacactgacactgataatactgtccgttcttctcgatctcccggctcttttttccctcctgtatggacttcgccagctcctccgcctcctgcatgtatccgcggtgcctgcggctgtttctctcatacaactgcatcggacccgcaaacagacttctgccgctgcggttcgcatcaacgcaataaaaattggtatccagcagtaccactgccgtatccgagtcatcgtacagccgctcgcgcagaagctcgcccgtatccatcagctgatccgtctggatcagataatgaaccgcaccgcagacaccagttgtagctgccagcatcagaagattgcccggaatagtaaaaaacttttccgcgcacatcgctgctgcattcacgagcagcacaatatagagcagattggcaatctgatgctcatgcatggtcagggaacggcgcagataggcgtaggtccccattgcaacgatcgccgccgtacatccgattaagtaaattctgaaataaatgtgatagatttccggctgccggtagcgcataaaaacaatcacattcagcgcgagcagcacacaaaacataatccactgcaccccgtaggggatatggattttcagaaaatccatgatatagataagaatcagataaagcacctgaattaagagcatgtccttcaaacgcccgaacaattctgtctgtccggtgagcgtaaggacaacctgatagaaattatatacaccgatcagtccgaccagcagcggcagcagcctgtgctgtctggaatatgcaccggaagtggcatattcctgcagtacatacagcgtataacaaagacatattatctgaaccaataatatcattcaatctcactccgccccatcagaatcctcttgatctctgtcttgacaaagaccggcttgtacggtcttacaatgtaacctgccgcgtccagattccggcacagcgtgaccgtctgtctgtcgcagagcgccgtgacgaacaggatcggcaccgtgtgatccgtcatctccataatgcgtttggccgtctcgataccgtccatctccggcatatcgatatccatcagcaccagatccggcgccggatgttttttcaaatacagcaatgcctggtgaccggatttcatcaggatgacatcatataacggctctaaaatgccacgcagcatctgcagattcgtcttcatatcgtccacaaccatgatccggcagcgtaccggcgggcgtatcatctcgttgcgctccttttctgcctcttccgtggagaagccggattccgtcttcatacgcaatgtaatatggtagttcgcttcgttggacagatccaacagttccccgtccatcagacgcactacgggtcttaaattatgtacgccaaaattctcatagatgatggcttctcttccatcggaaagcgtaaccatcgttcccttcggatagagcggcacatactttagaagtgtctccactacctcgcggtcaaacatgatgccgcagccgcccatcagatactctgtcgcctcgtacggtgcgtatggctccttgtacgggcgcctggacgtaagtgcatcatagacatccgccacgtgcagaatcctggtaaacatcgtctgctgcgcgccttccagcccgtccgggtatccgcttccgtccacattttcatggtgatgcagcacggcctccttgatatgcgcagaaatatcccaccgctcactgataatctggtacgacagtgttgcgtgggatttcataatcagatattcttcctgtgtcagacgtcccggcttgtttaagatctcatccgggatctgcagctttccgaggtcatgaagcaatgccgcagtcacaagatgccccagctccacttcactcatccccatacccattccaatgacgccgcagtataccgccacgttcacagaatgtgcgtaagtgtaatcgtcgtagcttcttaagtccgtaagatcaagagacacatttccgcaggataaaatctcctccaccatgcgtctggcaatcaacttacatccgtcaatgtcgcaggcacggatgcgctcctgtccctcctgccttaactgcggcgtaatcacactctcaatcgtgatgccctctgaaagtttatcttctatatatataccgtcgaatccgtaagcttccagtttttccagatagctctccgtcaattcgcaatggcagccaatcaacgttcttccgacggaatcataaaggtcggctgcaagaaccatgcccggttctgcctccctgagtggtacataacgcataacattcctcctacctttcactgtaccaagccgacctcataaagtcaatgaaacttttgaccttattttctaggattcgacagaaaccacctcgtaatcctgatcctcaaccgccttctttaagacctcatccgccacgtcgctgctaagcgtcacaaccgcgtttcctgcctcgtggctgactacagcctcctgcacgccttctaccgcttcgagtgccttcttgactctcgcctcacagtgtccacacatcataccgttaatcttcattgtctttttcattgtctcattctcctttttttgatttgtttctgatttcttctccaaagcgtcatccggctccttcgccgcagctgcggcggtctgccctgtcaccgcatttttgatcctgcggtcttttccgacgtcatacatccggaacagattcaggcgcagcgcgttggtcacaacacagaaactggataagctcatggctgccgcaccgaacatcgggtttaactgccagccgaacagcggaatccacacgcctgccgcaagaggaatgccgataatattgtagaaaaatgcccagaacagattttcatgaatattgcgcagggttgcgcggctcaagcggattgccgcaggcacatccgacaggcggctcttcatcagcacgacatccgcggcatcaatggcaatatccgttccggcgccgatcgccattccgatatccgcccttgtaagcgccggcgcgtcattgattccatcgccgaccatgaccactttgccctttttctgcagttctcttaccacctgctccttgccgtccggaagcacgccggcgatcacctcgtccacgcctgcctcttttccgatcgcctgcgccgtccgctcattgtcgccggtcagcatcaccacatagattcccatgttctgcagttctgccaccgcacgcgggctgtcctccttgatgacatccgccacggcgattacgccgagcagcttctcatcctttgcaaaaaacagcggcgtcttgccctgcatggcgagctgctctgcctgccgcttcatggcatcgggcaccttcacgtgctgctcgataaagatgagattgccgccgtaaagccgtcttccatcccgcacaccggtcagaccattgcccggaagcgccatgaaatcggtcagcatatcttctaggccgtccgctccgccagatgctccgcctgccgcagacgccctcttcccgccggactgcgcctttgccccggcctgctccttcacataggcaagaacggcctttgcaagcggatgctcgctcttctgctccagaatccctgccgcatgcagcagcttctccgccggaacgccttccgccggaaggacatccgtaacccgtggctctccgctcgtgatggttccggtcttatcgagcgctacaatctgcatttttccggtctcctccagagagactgccgtcttgaacataataccgttcttagcacccatgccgtttccgaccatgatggctaccggagtggcaagtccgagcgcacacgggcagctgatgaccagaacagagatcgctctcgccagcgcaaagccgaccggctttccggcagctagccacacaatcagtgtcacgatcgcaattccaatgaccgtcggtacaaatacgcccgataccttatcggcaatcttggcaatcggcgccttggtcgccgcggcatcgctgaccatctggatgatctgggataaggttgtatcctcgccgactcgcgccgcctcgcattttaaaaagccggactggttcacggtcgccgcggagacttcatctcctggcgccttgtccaccggtatgctctcgccggtcagcgccgcctcattcacggcactgctgccctcgaggatgataccgtccacgggtatgttctcccccgggcgcaccacgaagacgtctccctttttgacctgcgcgaccggaacctcctgttccacaccgtcacgcacgatggtggctgtcttcggtgccaggctcatcaggctcttgagcgcatcggtcgtcttgccttttgaccgcgactcgagcatttttccgaccgtgatcagcgtcaaaatcatcgccgccgattcaaagtagaactcgtgcatatagcgcatgaccccgtccatatcgccgcgcacctgcgcatcggtcattgcaaagagtgcgtaggtactgtaaccgaacgccgccgttgcccccagcgctacgagtgtatccatattcggtgccctgtgccagagactcttgaatccgctgataaagaacttctggttgatgaccatgatcaccaccgccagcaaaagctgtaccagccccatcgccacatggtttccttcaaagaacgccggcagcggccatccccacatcatgtgtcccatggaaaaatacatcagcactgccagaaaacctaccgaagccaccagtctcttttttaaaagaggcgtctcccgatcctttaacatatcttcctgcggcatcgcctccgccgctcccgcggtttccgcgccgccccgcttcttctcggcagcgccgtatccggcgttctcaaccgcccggatgatctcctgcggcgccgcggttccctcgacacccatggaattcgtcagaagactcaccgagcaggatgtcacacccggcaccttcgacactgctttttccacgcgcgcgctgcacgccgcacagctcattcccgtcactgtatattgcttcatcttcctcactctcccgtctatttcatcaatttctggagcaccgtcaccagttcgtcgacggtctcctccctgccctcgcggatatcattcgtcacgcaggtcttgatatgattggcgagaagtaccttgttaaagctgttgagcgctgcattcacagctgccacctgtaccagaatatccgtacagtaggcatcccgctccaccattcccttaattccgcgaatctgtccctcgatgcggttcaagcggtgaatcatatccttatattctttctctgaccgttcctttgtcttatgggaacagcagcattccttttcctctgccatacgcttagccctctttcttactatttacccgcaagtctgtttctattcctcatttgcaggctcattatatacccccttggggtatattgcaagtgttttattgtgttatttttctcatcaaaaaaatcccggcctgtccaaccggaccagccaggatcttttgggaatctgccgtcatgcggcagtctcttttatttatccgcaaaccctctccagaatctctgtaagtgcacttccgctgctggtatggcttctcaccacatccgcattgcagcgctccgcctctgccaccgcacaccgtaccatcttatgtgatacggtgttggtgaagagaatgatcagatccggtgatccgatctggttcccgagctttgccggcatctgtgtaaataccttcgctttacagttatgttccttacagatctttttgtactggcagaccatgcggtcatgtccacctacaatcacaacgctcataactacaccgtcgcaagctgcttaccgagatcagtgcaggcagccacagcctcatcgtccggtgcctccttacagatcacgccttcgccgtttaatacattcgcacctgcggatgacatgcggtctacccagtcacgcatccactgcccgtctccccagccataggaaccgaacagaccgatggtcttgcctgccgcaaatccttccacctcggttacgaaaggctccatctcgccctcctcaagaacctcagcccccattgccgggcatccgagtgcaaatgcctttgcattctttaattcatctgtagagacgctgcttacgtccaccactgcggcttccttacctgctgcagtgattccggcaccgactgcctctgccatcgcctgtgtatttcctgactgtgaccagtatactacataaatcttatccaacacttttccctcctgctatatctctgtattctgctatgtaagttagtcttaactaactttagctatactatactaaataagaagggtttcgtcaagtgcagtaaatgaaatatttttctcattagaaaactgctattccacttcatccgcgaacttcgtcaggtagcgctgattctcctcaaattcgcaggtactcgcattgtcaagcaccttgcgcccgtagaaaacgcgcttttcctccacagggatcgacagtgtcgccgtgccgttctccgtctcgtaggagacttcgtcaatccccgtctcaccaagtgcccgatatgcgtcatacagcgtgtgatccctgtatccgttcaccatctcccagtagagagcatacttgtcactggttagccggtacaaatccaatgtatcatataattcatgatatccgcgatctatgtactccctttcacaccagtccagatgataggcatcgccggaatattttccctcatccacagcggtatcaatcaaagcccacaatatcgagaacacgaaaaacagcgcaatcacacatccggctgccttgactgccagcgtcgacatatttacctcgtagtttccagtctcatccgaaaatttccagagtatttttatatttttaatcttcctcataatcccagccctttctctcaaagatccggcgtatcagttcgtccatctcctccgagtcgcgctccatccccatcagatccgccagttcctcctccgtcatttccagagtaccaagcagtgccgctgccacgtcctgtttcatgtcatcatagtattccttgttttcttcatactccagcccgcggtaggaaaaatctgtctccatttcgagaatatccttcccgtccagaagcacatatttcacccagtttggacgcatctgctgcccggtgggccagtctaacacctcctggatgcggaacagatctctcataaatgcctgatcgtcgtcatacagccggacgcgctccgtatatttttcaaattcctcctgcccatacacctcataggaatgcagataatcgtaaagtccggtataatcctctgccgcaagcagttcttccgcctcctgtacagacgcccgattccgctggcaggtaatgtgaatgttctccagaccaactccaatcgcgagcaccagaatcgtaatcgctgtcactgccacaacaaccagcagaattacattcatcactttatccgccacatacagcggcatggaatggatgatctttgctttggcgagcagtgtctcctttctcgccagattttcctcgtttctccacttttctccaagcgggtttggctccccgcagtagggacatttcagttctttcgccggataatcatatccgcattttttacatatcatcttcgcacacgccctcgcttttattccgtaagatgggaaaatgcccgctcctgcatcatccgctccagattgctctgattcgcttcatctgcaggatcatatcctgtcatcacttcccggatctcttcctttgtcagcgcataatgctcctctaaataagtataacaatattcccggtaataagtgaccgcttcctgctcttcgtacttgtaatcagcatcttcgctctcctgacagatgcaaagagcatccgtgatatacttcacatcatccagctcttccgctcttccctcccggataagctgttccagatactgcccgtccggggttatgacgtaattcgcggtatagtcttcgagcttctccaccagccggtatttgcgaaaagcctgatcatatagttcattatgcttttccagatacgtgcagattccactgtagtcctgctgctgatacatcttctccagtttttcctgcattgcctgctccctgctgccggaagcagccgcgtgaatgcgtatgccaataaacgccgcagcactgagcaaaagccctgccacgatcacaacaatcaaaatcttcgcggtcagggacatcccggtcttcgccatccgctgcggcttctcctcccactgccgtttctcgcgtttcagctcattgacggcatcctcatgcatctgtacggaccttccaaaattatcgccaccgcaatatggacaacgcggctcgtcatcttcataagacgcaccgcagttattacatacgatcatcgtttctccctccggtgcctccgcagaaatccgctccctgaggcaccctgtgttattctttgtctattatatcagttttttcctgtataggaagcattttcctatgaaccaaaaaagcggggcagtcgcttgaaacggacagccccttttggagtgagaagtaatagaaaaagaagcacatcctaccgatttctgatggaatacatctggaaattcggttcaaaaaatgtggcatttctaaccagccgaatgtttgcatcttcgatgatccgtgtctttccaagtttggagcactccgcgggtgtgtccgcaacccgcagacaattttaggattccctagtgtcccttgcggcaccagggaatccgctcattgtctgtggcttgtcggacacactccgtggattgtccaaacgtggaagagacacggaatccgatgcaaacactcagctggaagaaatgctcacatttttctcaaacgaatattccatctgcatttccatcagaaatcgaaaggcatgatctttttgatatattacttctcacgacaaaagggaccatctgcttcaagcgacagtccctctttttcgttcataggttctataatttttatttctactccgtctttaatgcacgcatggaatttaagatcgcaatgacagatactccgacatctgcaaacactgcttcccacatgttcgccacaccaaatgcaccgagaaccagcacgatcgctttgaccgccagtgcaaagacgatgttctgctttacaatgccgagtgtctttctggaaatccgcacgatcgacgcaatcttccggatatcgtcgtccatcagaaccacatctgccgcctcaatcgccgcgtcagatcccatgcttcccatcgcaataccgatgtccgctctggtgagcaccggcgcatcgttgataccgtcaccgacgaatgccagcttttctttctcgttctcttcttttaacaggcgctccacctgtgacactttatcctgcggaagcagttctgcatgcacctcgtcgatgccgagttccgcaacgattccctctgccgcttcttttctgtcgccggtcagcatgacacatttcttcacacccactttcttcatggaggcaatcgcctcttttgctccgtcctttaccgtatcggcaatcacaatgcttccgaggaattttccttctcttgccacatagacaacggttccgatgttcttgcacggctcatagaaaattgctttttccttcatcagcttctcattgccgatgagcacatttcttccgtcgattctgacactgattccgtgtccagccacttcctcggcatctgtgatacggttcatgtcaagttcttttccataggcttcccggatggatgccgcaatcgggtgattcgagtatccctcgccgagcgccgcaatctctaaaagttcctctttgcttccctcggtcggcagaatctcggaaaccttgaattcgccctttgtcagcgtacccgtcttgtcaaagacaatcgttgtcatttcagctacagcttcgagataattgcttccctttacaagtacgcccaccttcgacgctgcaccgattccgccaaagaatcccagcggcacagagatcacaagtgcgcacgggcaggagataacaaggaaaatgcaggctctctgaatccagtcgctccatcctccgccgagaatgagcggcggcagaattgccagaatcaccgcaccgatcgtgacaaccggtgtatagtattttgcaaaacgcgtgataaagttttccacgcgtgcctttttgctgctcgcgttttccacaagttccagaatctttgcaacggtggagtcatcgaactccttggtcgtctgtactttcagcgtaccgcttccgttgacacagccgctgatgatctcatctccggctgccgccttgcgcggaaccgattctccggtcagcgccgctgtatcaatgaaggactccccttccagcacaatgccgtccagcggaatacgctcgcccggttttaccacgatcatgctgccgacctccacatcatccgggtcgacctgcgtcagttttccgtccacctcaatgttggcatactccggacagatgtccatcatcgctgagatcgactgtctggacttgccgaccgcatatccctggaacagctcacccacctggtaaaacagcataacggcaaccgcttccgagtattccttcacgccaaacgcgccaaacgtcgccaccatcatcaggaagttttcatcaaacacctgtccgtggctgatattccgcaccgctttatatacaatgtcatatccgatgaccaggtaaggcaccagatagatgacaaataatatccatgtattgattccttccaatgcccccgtatgctccgccaccatcagggctgcgaacaggacaaaggatatgatgatccgaaccagcatccgtttctgtttcttcgtcataccacacacctcgcttttgattttcataaacatataaacatttgtttatatgtattcctttttctaagcctgcgcgccttccggcacacaggctttcatagaattgtctttcgttctctgtcaggcacacgcccgtgttattacattaagatcttgcagtccggctctacttttgcgcagacggaaacgacttctttcatgatgtcgtcgaacttgtcatcctctgcatctaccgtcatcttctgtgtcatgaagctgacatttgcatcattgacgcccggaatctttttgattgcctcttccatttttgctgcgcagtttgcacaatccagatcctctaatttgaattttttcttcatcgtcttatccttcctttctttttctttcttattcctaatatgttttcctgttgtacatatcctgttctttgcatcacataccgcccgctactcctcgatatgctctctgccctgggcgatgatcgtcctcacatgcccgtccgccagtgaataaaacacggactttccttctcttctgctgcgcaccagcttcgcctgctttaaaatcttaagctgatgtgagatggccggctgcgtcatgtgcagtgcttctgccaaatcgcacacacacacctccgcttcaaacagcacgaacagaattcttattcttgtagaatccccaaaaaccttgaacagttccgccagatcatataattcctcttcctccggcatctgatcgctcacaatcttcagacgatcctgatgaatctccacactctcgcaacattccagttctgcttcagacaacttctcaccctctttccttcaaacatatgaacaactgtttatatgtttataatatgctctgccatacactttgtcaagcatcatttttacaacttctggaaaaagatcaaataaaaaaaggctgtcggcaaacgacctcgattcgtctgccagacagcctccttagcaatgtgtatgctttgtatgtggttggctagttagttttatctaactgcatttactatagcacaatccgtcttctatagcaatactgcttattgaaaactattctcatttgctaattcttcttagcttctgccttcgccagaaaacgctcattgtcgatgataaatctctcgtgcgttccctcgccgatcactccggctgcatcgtatgcctttacctcaaatacaagccgctttctgtccacctcaaccagctttgtctcgcaggtcacctccatgccgaccggtgtggctgccacatgttttacattcatcagcgtaccgaccgttcctgctccctcttccagttcatccgccacacttttgtatgccgtattctccatcagggcaatcattgccggtgtcgcaaataccggaagcgtaccgcttcccatcgcctgcgctgtcttttcttctgttactgtaatggtctgtgttcctgtaattcctgcttccatttgtagattcatcctttcttctgcttttgctataaaattctgttttctactatatttatatcatattatcacattatgatctatcatgcccatttttctttcgcgaacggttaaagtatgcgaaagcaaaattgatgtcttttcccatataacaaaaagtcccggcgtacatcctaactaatgtgctccggaacttcctgttactattttgtactattcatatgacttcgccatgatacttctcacatgatgtccattcagatagccacatgccagaagtcctgactggatgatctgattccacttgctgctggagagctccacaatcgtgttgtcgtcaaattcgatcgtacatgcattttccatctcgcagtcctgatcgcaggtaatgcggtacatattctttctgctgatggctccgatctcctctagcgtattcaccatgcggtagacggtcgccgtaccgatcctgtcatccaatctggatgccttgtagtagatttccttacaacaggagcaatcctcctccagtataatatccagaagcatcaggcgctgtttggtgatgcggcagccgcgctcttttaacttctgtatgatattttccttctgcatctgggttctcagatatcttctgtcctgttccacttaagaacaatgtcctccgcagtttttacaatcgccgccgcactgcagggattttccgttctttttgtcatgaatcatgctgcgcacgatcaggcacacaacgattaccaaaattgctcctacaacaaatgttcccatatcgatcccccgctttctgccgaattactttgcctttacagcactctttacgtttacgttcaaagtctcgctctccttgtacggacggaacagcagataaatgaatccgatcacacaaaggaatgctacgactgtaccgaatccaaaatgtccggttgtgatcagtgtaccaatctggtagatgcacatggaaacaatgtaagccagaccacactgatatccgattgcaaaccagaaccactttgtattgttcatctctctcttgattgctcccatagctgcgaagcacggtgcgcataagaggttaaataccagatagccgtatgctgcgattggtgtcataacgcttgccaggttaccccagaactctgcaccatcttctgccactcccgcgaaaccgaacagcataccgaatgttgcaacgacgttttcttttgcgatcagaccgctgactgctgcaactgccatcttccagccgttgccgccctgtgtccatccaagcggtgtgaaaatccatgcgattgcggaaccgatctttgcaagaatgcactcagcctgtgccgcctcaagtgctgcaccttccagatcgccgaaatcaagcattccgaaggatccgtctgcccatccgaagttcattaagaaccacaggatgatggtcgataatgtgatgatggtacctgccttcttgataaaggaccatccacgctcccacatgctgcgcagaacgttgccgacggtcggccagtggtatgccggaagctccataacgaacggtgccggatcaccagcgaacatctttgtcttctttaaaatgataccggagcatacgattgctgcaactcctacaaaatatgcgctccatgcaacccatcctgcattgtcgaagaatgcacctgcgatcaatgcgatgatcggaagctttgcaccacacggaataaaggtggttgtcataactgtcatcttacggtcacgatcattctcaatcgttctggaagccatgacacccggcacaccacatccgctgccgattaacatcgggatgaaagatttaccggagagaccgaacttgcggaagatacgatccatgataaatgcaacacgtgccatatatccacaggactctaagaatgccaggaataagaaaagcacaagcatctgcggtacgaaaccaagtacggcgccgacaccggagataataccgtctacgataagacctgtcagccatgctgcacaacctgcattctcaagcagtgactgtgcgcccggaatgatccactcgccgaacagggtatcgttggtccagtctgtcaggatggctccgactgtagtaacagatacatagtaaactaagaacatgactaaggcgaagatcgggattgcagcccagcgattggttactacacggtcgatcttatccgatgtggacagcttctggctgttcttcggctttgtcacgcactcgccgatgatggaagaaatatatacataacgctcattggtaatgatactctcggtatcatcatcaaatgcatcctccagcttcttgatctcgtaagacacatccggaatgctcttcatctgctcgccgatcttgtcatcgcgctctaagagcttgatagcgaagaatctcttctgcgcctcatctacacttgatccaagctttgcttccacttcatggatcacatcttcaacttctttcgagaattcatgtaccggagttaccacacccttctgctgtgcaagtgccactgccttttctgcggccttcgtgatgccggttcccttcaatgcggagatctcaacaacctcacatccaagcttctggctgagcttgtcgatatgtaccttctcaccggtcttctctaagatatcaaccatgttgacagccatgataaccggaataccaagctccatgatctgtgtggagaggtaaaggttacgctcgatgttcgtgccatccacgatattgatgatcgcatccgggcgctcaccgatcaggtaatttcttgctaccacttcctccagtgtatacggagataaggaatagatacccggcaggtccatgatggtgacatccttatgtcccttcagcttaccttccttcttctcgactgtaacacccggccagttacctacgaactggttggaacccgtaagcgcgttaaacagtgttgtcttaccgcagtttgggttacctgctaatgcaattttaactgccattttctgctcctcttttcccgcagcgatttgtctgcgttatctttcttttatcattttctccgattttgattagtccgtgctaacctattatcaaaaaaaattactcgacttcgatcatttccgcatcagccttacgcagggacaactcatatcctctgaccgtgacctctaccggatctccaagcggtgcaacctttcttacatagatatccacacccttggtgatacccatatccatgatacgtctcttgaccggaccctctcctgtcagcttcttcaccttgacagtctgcccgcaggcaacttcctttaatgtcttcatactctgctccttctctgtatagttcatcatagcattgcctatgtctataccataatcttgttcgccatatcttttccaatggcaactctggaatccttgacattgacgatcatgttgccgcctgtctgggaaatgactgtcaccgtaccaccggtcacgaacccgagattctccaaaaactttctggtttcttccttaccgccgacttttttgatgatattcggctctccctcttttaccatagataacggcatcatttcatcctcttccttcgttcttgttgttgataatcattttcacttctattgcattggttagtataatctaacgttagttagttgtcaataacattgttgaaaaattttatcaataattatggtattggaaatctttgttagatcttacatttttttattctttcgaaagcgggactgtatatcattttactatatttatctttattacgaaaaaaacgcttaggctgtgaatcctaagcgtttttttcgtattcgtaaattattttaaatctcacttccatttgtttcaatcacatgcttataccaatagaagctatccttcttgtaacgattataagtaccttttccatagtcgtccgcatctacatatacaaatccatatcgttttgtcatctcagaagttgtggaacttacgagatcaatccatccccaataagtaacaccaaatacatccacaccatcctttatggcttcttttatctgctttaaatgcgcctctacaaattcgatacgtccctgatcgtgaatctgatgattgctgtccatactttcatacataccgatcccaaactcagctataaatatcggaagtccatagcgggtataaagctgatttaatgcaattctcagtccaaccggatcaatggaccagccccagtctgtcatcttcagataaggattattccggctctgatcaggaagcagccccgtaaatttcataggttcgccctgatactcagaaatattggacatataataactgaatgacaggaaatccgcttttcctttcttcaatgtctcaatatcttccggcgagtagtttctttttatgtttttctgctcaaaataccggtccagataatacggaaccacacccttgcattgaatatcatagaaataatagttgaggttcatatcaaatatctgctgcagagtatcttccggtctcacagttttcggatagtacacatgcttccataccatatttcccgcaagagcttcaggcgcaatctcatgtacaagaatcactgctttcgcactggccagaagcatattatgtacaacctcaaacgtaagctgttcttcgtctaatccttttaacgaatgatcgcgcatagctcccgagcaggtagaaagactctgaagactcatattgatttcattaaacgtcaaccagtattttacttttttatgatatctttctacgatagtccggacatatttttcaaacaaagcaatcgtttctcttgactcaaagccattcagcttttcacagactgccagcgggaaatcataatgtaacatagtgaccaacggttcaataccatatttgtgacactcatcaaaaaccttgtcatagaatgccagtccctcttcgttaggtttttcttcaaatcccgtcgggaaaatccgtgaccacgatatggacatacgaaacactgaaaatcccatttccgccatcaatgcaatatcttctttataatgatggtaaaaatcatttccccatcttttcggaaatatataggtatcttcatgtgcttttgcctcttgcagagatgcgtaggtctgctcaaaggtagcctcatccgcccgccgctcatttggtgctacatacttcaggaaatcggtatttgcaagccctctgccgccttcattataggcgccctcgatctgattggctgccgtcgctcctccccaaaggaaaccctttttgaaacttttctctcccatgttacttttccccctttttcatatttttcaggcactgatacagaatagaaatcatatactgttcgctttcaaccgtcatcagtgtatcctgtgcatgggaaaataacaccgtcataggaacgctgtctccctctgcttcattctggaggacagatgtctgcgccttatgcgcctctaccaattccgcagaagctttctttagaagctcctccactccgtccaaatccagagccgataatttggttcctgctttcctaatataatcccgggcatctcccgcatgcataatgacattcatcgctacctgaactaatttttcgctatccatttttctcctcttttcttaaagtatttacttcctgttcactctccagttcctgtttttcataaactttgaaaaacggaagatatatcaaataagtcagtacaaataaaaccgcccaaagaataataccacgaaaatcgctgtttaccataaaggtggaaataggctgtggcaggaagttcatcatcatggcaactgccggaatagacaccagtcccagtttaaatacaatataggtaatcgtaggaacaacaaaggatactgtcatatatccaagcatcataaccggatttaaaacaaccggcagaccatacataaccggctcgttgatattaaaaatagaagaagcaatcgccgcttttccaatggtactaattttctttgacctggaacggatcatcaaaatgttcagtggaagtgtacatcccaatcctcccagacaacaccagcccatgaaaaccaattcatcggtagcaatatagatcggagcctggcctgctgccacagcagccgcatttgctgcaatattagtcagatacaacgcacatacgatgggccaaaccgtccacgccgagagtccacagcaataacacaatgccataatcatatagaaaagcaggaatcccagataagtatttccgattgccgcaagcggactgaacactttttccaacagtgaaaataaatccacgttctgtccaatgatgatacatactaaaatcaaaacaaaaatgatcaggatagactcaaaccatacaaccactaccgacggaagagaactgtccttcttaaacagaccatgtttaaagtaagcagaaaacagccagccaatcaccagccccatgaccattgctactgtcatgcctcccgtcccaacatagccggagtttattacgagatttccatccacatactgaggatttgccagtgcaatcaatgcagatacagacgcaaatcccgttatcattttttgcttctggagcttcttgctttccataatcgtgtaaggaatcaaaaacgccataaaaatggaaatcagcccaaaggaaaaagaattgatcaggctcagatccggaagccatggagcaaagttccgaaacgtattaaccagacttgccaatgaaccaaccataatcataggcagaattatcgtaaaacacacctgaagcgcatgcatatacgggttctgcataaacttctgcattttctgtgaaaatggacctgccagccaatcctgtaatttcatataaaatttcatatgtactcctccttctcaaatcagatttttcgcaagctcgaaacattttgttccatccagtgtggaaaatgcataattgtcaatgatcgcatattttttcccatgttcctcacaggtttcacgaatcatctcctcattacatttcatctgaggcgctgccagtaccacatcaaagtcatcaatgacctccggcagttctgtataactgtaggcttccgtgtctacatcatacccctgggcttttcctgcttttcctgtccgcgatgcaatcattccgctggatacgccgtttccacaaataaataaaatcctcattacattatccccttcctctgttatatttttgatgaattcattatccattattttcaaacttatatctatcctccgagcttcctacccactaggaaaggaatggattgatatagataatctcttatattataataaataagattaaatttataaaatacaaaaagctgctggttttataatatattggcacctttcacagaaaggcagattataataatgaataaccttcaaaagctgcttacagttttaaaacaatcagatacaccgctttcgtcacggcaattgagctctttgctttctgtttccgaccgttccgtccgtaactatatcaaggaactcagaaacgccggtgaacaaattaccgcaaatgaaaacggctatctctggatcggaataaagaacgatgagcctgacagccctggtaacaaatcgcaggctttatttgcattcgccactccggaggagcgtattaattacattattgaaaagctaatactggccaaatccggccttgatttatacgatctggctgactctatttacatcagctattccaccattgaaaaagatatgatccgggtaaaaaagaaactcgcccttttcaatctgagtattcaccgccaaaacggaacaatcgatattgtcggtgaagaacatcataaacgagctctcttttcccattatcttacctcgaatctggattctaccatagatctgactttagagtcattctgtaagcttttgaatatttctccagattctttgcgggcaattgtccatgaagccttgcagaccgaaaacctttatgcctccgattacgctttcaaaagcattattattcatgtcattatcaatatgacccgtatcaaaatcagggaatgtctattagaaaagccactttacgacagcgtgacaattcacactgccgaatatcgtgccgccagccggatctttgaccagatctcgcgcttatgccccatacagtttaacgaaaatgaactgcagcagctggcattcattatcatgacaaaaacaagtgcaatcaacatcaataatgtcattgacctgccccggattgtggacagcgcacttattcagtttgtcaatgaaattataaaacaggtaaaaaccatttactatattgatttatatgacacggattttattaattttttcactgtccatctctccaatgcactatttcgatgcaggcacaatgtttccatccggactcccttgtcagatgagatttttattcagaatccgttaatttacgaaatcgccgtttttattgcacaagaaattaaaactacttttggttatgagttaaataaagatgagataacttttatatctcttcatgtaggtgctgttcttgggaaaaaaatggatgaacatcccgaaataaaggcagttctggtagtaaataattattataactattacaataagcattctctggaatccattactcaaaaattatccggaaaatgcaaaattgcggaggttactaacactctggatgacgttaatcctgcttactatgatttgattattgatgccacgaatcaggttctgccacaggccaatctcagagtcatacaaacaaatacaattattacagagcatgattttaaaaaaatacaatctgcctgtaacgaacttctggctgaaaaaaaacgcagaatattccacgataaactaattagttttatggatccgcaattatttgaaaaaaatcattacgaaaattctgtggaagatatgatacgctatatggcagaaaaactggttgctctgggtattgctccggaagcttttactgactctgttctggaacgggaggctgttacccccaccagttttgacaacaaagtggcaatcccacattccatcgtctgctctacccaaaaaaatattggatttgtaatcgttaacgaaaaacctcttcgctggggaacctttgatgttcaaattattatgatgatcggcgtcaaccatcagcagcgtatggattttaaatatgtctattctaatttactggagcattttgagaacagcactaccgtagaaaagcttatccacgcatcagattttcataattttattgacatactgacctcctgatcctaatttttatctgtcctctaatctggaaataaacagactgccaaacatatatttctcagtcaaaaaaataaagtgtgtaagttttgttaacaccaacaacttacacactttattttatgttcttatcaaactccgtcccttccgggacggagttttcatttctgatctgtgttttatttctcagcacgtgcgattgcaaccttgaaatccttggtatctgcaaagatctcgttcttgtaaggattcttcttctgctcgattgcgcgcttgatgattacgcttaagcagatgacatttgcaaccaatgcaatgattgccatgaatccctgtaccttggtgttcggtgctacgctggtcagatccattgtcgttaaggagaacgcatccagagactcaaagccctctacgttagagtagagtaccggaagtacagagaaacgtcccttgatctggaacatcggaaccacctgtgcgaacatacaccaggttgccagcgtattggcacggttctgaatccagccacccttgttccaaagtgcatttgcgaatgtcggtgcaagaagcagagccagaccgcaataccaggaatgcgtcggcaggttattgtatgtataggtaaagttccaaagatcatatgccacgataaaccataccgtcatatccggccataacatatcctgatgattcttgtccttggatgcataaattccccaccagcctgtcatacagaagatgttgaggatacctgcgataccattaacccagttccaccagccaccgttcagccatacatcctcgatggaataccaccagccattgactgcctgtgcgcctttgattgcggactcaaaatcagaagcaactgcaatcatgatgttgattgcaacgattacaaacggccaaaccttgaaccaattggtcttaccgatccactgcttgtactttaagaacatgaaaccgatgcatccaaatgctgctgcatataactttgcataatggaaccagccacccatatatacataggtatcattggttgcaccccagccaccatttgcggcgctgatctgaatagcgataaagtatacagtaagaattgcaagaactcctacgaaaataccataaccgccaagttttgtgcggcgctcaatctcatttaagattacaagtcctgcaaatacgagaacccatcccaggagctgccacatgctgttaatctggaataacataactttttcctcctttgtcttattaaaaatatgatactccctcgaaccgtcatgccaggtatctggtatgaccagtccacaaatgaattttaatactttttttagaaaattacaagtatttttacaattattaacaaaatctggtatgaccactgttcagaattgcctgttatcccctgccggcacgcattttctgccggttcatgctatcttacgccttctcatccaccttgattcccttcagatccgcttcaagcactttcatgctgctcttgatgtcgcccaggttctgatccacactcttcttcagatctgcgctgtccgccagatccaccatgtccgtcatctgaatgtccgggctgtcattctggcgcttgatgcgctccgcctcttccactgcttcatcggttccctcgatcatcgcgcgctcaatcgcgcgctccagcttcatctcatccagcttttcctcgcgcttttccctctccttcatggcttcgtcggctttttccttcgcctcgtccatcttctcatcctgctggtcttttacctcctgcacaagcattccgataatctcgtcgtttgccgcatccatgatgtcatccgcagctccctgcgcgtcaaccatcgcatgcgtcttcaagcgctccagcttgatacgggagacgttctgtttctccgcagtcataccgtaatcagctctccggatctccctcttgtgatccgccgcataattgttcagctccagcgcctgcttctgatactcagtcagcggctttttgtggatctccgccagtctgtcgtattcttcgtccgtcagcccttcatccagaacgccgttcttataatcctgttctttttccagaaggagcagatcctgctgctcctgggaatccgcgtccacgccgcactgctcccgcaatgtttccttctgccggttcgtcttatcgattgcagccagtgctccctttttgcggttctccagctccgcgtagctgtcccggtggctctgtatggtgtcatctaccgaccggtcatttttccacgcattttccacaaccttccacgcctgccgtctcgcttcctccctgcgctttgccactggatcttccccgagctttgtcgcgccgccgaacgctgcgttttttactgtccgtacgctctgtccatcctttgttcccatatggacactgttgttaaaacctgccgcattaactgtcagtttcatactcattttccccccgtatcaaaccagaatacgtctccgtgtgttactgctgctcctccgtctgtgtcagcgcgatcagctcctgtgagcgtccggcgatcgttaaaagatgctgcatattttcttgctccgccgcaagcgtctcgttcgcatgtgccgatacctcctccgacactgccgagatcgtctgcacggaatcagcaatctcctgatttgccgcctcaagctgtgaaacgctctccgtcagtctcgccacattatcgcggatcgcataggtatgttcctcaatcgtaccaaagcttgccgacgcatttccggacatttccttttcctcattgattccgtcaatcatctcacggatgactgtcacaacctccgtgatagaaccggacacattgccgatcagctgtgtgatgttggtcgttgcgctcttggtctgggttgcaagctccgagatctcggatgccacgaccgcaaacccttttcctgcctctcctgcgcgtgccgcctcaatacttgcatttaacgccagcaggctggtctgggaagtcacaccgttgataagttctacaattgtattcatctcactgatatactgattcagcgtctcgagcttatccgcggcattggcactgtttcgcacagatacttcaacctctcccaccagggtatccatatccgcttttcccttttccagcacagaaagcgtcttttccatgcgctcggtaatatccgatgcaaccgtactgacaagccctactttctctccgattgtctccgtctgtgccagctgtctctgcactgcctccgccgtgtccgtcgcgccgatggttacctgtcccatcgcgtccttggtcgtctccgatgccgactgcagctgctccacttttgcatggatctcattgattccgcgtctcatcacatccgcattccgggagacatccccgagaaccttttcggtctcgccctgcgcatcctttacctgctgcagcttctccctgctgttcgtctcggaagtcgccgctgcgatataggaatacgcgcagaacaaaagtaccgccagaatctggatcacgccggaactcatatcacggaaaccgaatctgccggttgtcgctccaagaatcacaaccagaagattctctatcacaaccccgatattgaccttgagggcatacgccttgtcattgtatacggaaatcacaacaatcatcggaaatacatacaaaaacagcatgttgttggtcgtcgtaaacaaaatgaccgtgtacatcacagcgaatccctgcgccaccaggtgcttgatcgccgggctttccttgtccctgctccagaaaaaaagctccatcagaggcggtcccatcgccagcacaacaaccagcagagagtacagcagtcccctgctgcccaccagaagctgtgcgataaacgtaattgtaatcatcgacgcctccaccagatggcagatcatagccgtccggttgcagcgcgccatatcagataacgttcttttgtccatttgtcattcctccgtacaccttgacaccattcttttactctaaagtatcatttttttcgccctgtcgcaatatttgtaataaaaactcgtccaatttttaacattttttgaaaattggacaaatccaactttcttttctgtcacatgcggacgcgctcacgcagctgcagcagcagctttttttccaggcggcttacctgcacctgactcatcgacagcagttctgccacctcgcactgtgtctttccctcgtagtatctgagttgcagcagacggcgctcacgctcgccgacggtctccaacagctgttccaccagaatgtggtttaggaccgcttccttctccggctcctcccgctccgcgctctgccctccgcttccctccatctgatcgatcagcagcagctcctccccgtcgcgctcatagaccggctgataaatggacgccacctcccggtttgcctcaagtgccagcacgatctcctcgtgctccagcccggcggcttccgccagttcctccatcgtcggctctctccccagttccctggtaagcatttctcccgccctgcggattttatagccgttctcctttaaggttctgctgacttttaccataccgtcatcccgcagaaaacgcctgatctccccggtaatcatcggtaccgcgtaggtggaaaaggcaagctgcagcgatacgtcaaatttgtcgatagccttcatcagcccgatgcagccgatctggaacagttcctccctgtcatgtcctctgtgttcaaaacgcctcgtcaccgcgtgcaccagtcccaagttttctgccaccagccggttccttgcgtccttgtcccccgcgtgagcctgtctgatctgttccgtccaaagctccataacgttcagccttcctgcacgccaatgtattttttcatgcgcacgctggttccttttccgggcgcagactgaacctgaacttcatccataaacgcttccatgaacgcaaatcccatcccggagcgctccagttccggctttgtggtgtagaacggttccattgcccgcgccacatcctcaatccccctgcccgtatcacagacgatgatctccacttcccgtcccatgatcctgcatgtcatatgtaccttttcccccggattgtcatacccgtgaatgattgcattggtcaccgcctccgacacggccgtcttgacatccgagagttcatccatcgtcggattcagctctgtgataaacgcagccaccgccattctggcaaatccctcattgacggaacgcgcatcaaaacttaattccacttcattcttactatgcattgtgattctccccttcccgctctttctgctgcttaggtacgcttgtccgtatcagcgtgtgaagtccggacaccttaaaaatcttaaggattctgccgcttaaatgttccgcatacacctcaccgccaaaatatcccatcttccggctccgcccgataatcaccccgattccggagctgtccatgaactccgttcccgcaaaatcaaacacgagcgtcttcacctgaccggtctcaataaagaaatccgcctcctgtttcaggcggtctgcctcatgatgatcgagttccctcgggacatacacccgcaggcagtttttttcctgttcgcaatatctttccatcctttttcctccctttcttttctttatggcatttttgtataataggaacaaagtttcctatgaaacaaaaaagacgccggtacggactgctccgttcgacgtcttttgtatcataattcttttgtcttatcactgttgtgtctgtttgcgcagtaccctgcttcttcctgtccccgcttattcttcggtgttcagatacctctgtgcattggcagcgcgctcggttcccggatacagatccgcaaacttctgataataggtcttggcattgtccatgtcgtcattcctgcggtaagactgcgcaaggtagtacagcgcattgccgttgtcgtaggtttcatcgagttcgatcaccttgaggtaatcctcgattgcctgtgtaaactcctgcgcattgtaagcatctgttgcttccttatatacggcgctgatatactccgcgtttacctgtgcattgatcgtatcgtacacagtcatggagtcatccgaaagataatcggtattgacgttgccgagtgccgtccccgccttctcgatgtcaccgtcggtgtacgccacatacgcctgcagaagctgctcgtaagtgttgacctttccggcgctgctctcctcctcgttcttcgcatccgtgatctgtgatgtgagatcttcaatctgcgcttctaaggaactgatgctctgattcttggatgccacggcattgttggcgtcaagaacctccgctttcgcctgattctggatctccctgcgcactcccggcacaatcagaaagcaggtgatcgccgcaccgattgcaattccgatcaccatattgatgatcgttccgattgcggaattgtccttgagatagcgcggctggatgatggtctcattgccgctctgataggagatcagatcctcgttcttctgctttttcgggttattctcacgcaatccggcgttgacttcttttaaatagcgcagcgtcgtggtgttgttggcgtcaatttttcccgcattccgaagcgacttcttggcaaggtcgtacttcttctcctgaatgtagaggagcgccagcaactgatgaccgcttaccagcttcggatttaaggacagcactttcttgagctggatgatcgccagatcccggctgtcctgtctgcagtacagcagcgcctggttgtattttttgatcgtctggttgatcgtatccagccttgacggattgttctggatctcatttaaataccggcttgcggcgttgtccctcggctggtaattcttgctgatgacccactccgtcaacgcttcgaccacctcgcccgtctcgaagtagaccagtccgagcaggttgcgcgcatcgatattcatcttataaaaacgaaggctggtcctaagactctctatcgcgccggacaggtcccgcactgccgccttctctaacgcatcattatagtaggcattggacgccataatgatctttttgtatattttaacattggctccgcagttctggcagatatcgcccttgcccagcttcgccccgcaattataacattccatggaaaacctcactttatcaatcctgaccctgcctgcttctacatgccgcgcttcatatcctgcaggatctcctgcaatacgtccgtcatatccgtgagttcatgattatagatagcctgctccgcctcttccacttccaggctcggcttaaaattctttaattcttcttcaaaattgatcactgttatcacctctgtcatcaatataaaaacaccactatattattcactttctcattataatatagtggtgctaataatcaagctatttttgacgcagaaacttctgctattcgacaccggcgctgcacggtcttgttccgatcttgtccggtaatttgtaaaattccactccggttgccatatttttcaaggcaagcttcaactcgtccatattgatgaccacaccgggataaatctcctggagcaccgagacacaagccccttttgaactctctgcaagaatacggagcttccgcacttcctcctcgtcgctggcaagcattgcagaatccttgatcttaatccgaagcagcgacgtccggcgcggatcgttcgtgtagctgacgccacgctccttggagagaatctcgaacttctccaatccttcctcgatcttcgccagttcctccctcgtcatctcgatcttcttctccatgacacgcaggcggctgtacacatcaattccggcaccgacaaagatctcggtgcgcttctcggcatcattgccaagcgaggttgcaatcagtccgcggatcgcctgtaccttaccgccgataatactgccctttcttccggtcagacgtatctgcccatggcagatcaccgaacaatccatcagcacatccgcctgcagatcaccctcacacagaatgttcgtgaactcaaaaaacttcgcagtaatcgcgcccttcgtcttcacagacgccttgttgccgccgagcataccgcctcttaggatgatgtccttgccggcttccagcatgcacgcttcggcgacaccgtcgatcgtgattgatccggttgcccggatgttgacgccgctctccacattcccgtgaatgacaatatctccgcggaagtcgatattaccctctgctagctctgcattccccgagacttcatgtaccggaagaaccacaatccggtcattctgcatctcgatcttaccgtccatggaagccgtataagttacctcatcgtccatacgatcgaaacctttgccctttaacggcatctgttctcttccgtgcttggcaggcaccagcctgcccttgaccgacattccatcctcgccagacacagcagggtgatacacggcaatcacctgaccggcagtcacagactcgatcgaatgtaccgaccagtaatccacagaaccgtccggcagaagcttcggcttgccgtcaaagttcgtgtcgaacttgtattcgtagtaaccgtccgttccatccaccggcttcttcccctgcgcgaccagaagctctgcattgtatgtatgcccctccagcatatcggaaatccgctgctcatctatgcctgtggtgattcctctcgctgccatctcctgccggatctgggagtccgtataccctgttccctgttccggctccgggagcagcatataggcctccatctcatcaaatgttatgcgtataataggtttctgttgtgtaagttccgccatagtctgccgctccccaatctgtgtaaatcccacctgctactgtcaatccatctacattctatcatactagtccgatggtactttttcaagtacatctttttgcgtttccggtacaatacgcagggtttctctaactcttttctagcggttcatctgtgcgagccgttcctcgacctgtgccatcatctgctcgtaccctgcgagtttctctttttcctcctgaacctttgcctccggagccttgcttaagaatttttcattggaaagcattcctctggaacgggcgagttctttggtcagacgctctttttcttttaagaggcgttccttctccttctcaaaatcgaccagatcctcaagcggcagatacagtgttgctcccggaattacgacagataccgcatcatcctcgattccgttcttgtctgcctgtacactcacatcgcttgcgcctgccagattctgatatgcctctcttgtcttctcaaatgtctcacgcagtgcggcatcgtctgccacaatgaaaatctttgcttttcttgaaggcggcacatccatctccgtacgcacgttgcggacaccttttaccagatccttgcagtgctctaacatctcttcctctgccgggaaattccagtctgcgcggtactccggccattttgccagcatgatcgtctcctctttgggatgcagtgtgcagaaaatctcctccgtgataaacggcataaacggatgcagcagctttaacgcctctgtgagcaccgtctttaatgtccagaacgccgcatttgctgaaaccggatcctgctctttgttgtaggtgcgcgtcttggtaatctcaatgtaccagtcacagaactcatcccagatgaagtcgtaaaccttctgcactgcgattcccatctcgtacttgtccatgttctcggtcacgtccttggcaagtgtattcacctttgagagaatccacttgtccgccggctgtaactcatccgcggacggctcggttatcgcagccccctccagattcatcatgataaaacgggatgcattccagactttgttggcaaagtttctggatgactcgactctctcccagtagaaacgcatgtcgttgcccggtgcatttccggtaattaacgtcagacggagcgcatctgcgccgtacttgtcgatgacctcaagcggatcgataccattgccgagcgatttgctcatcttgcgtccctgggaatcgcgcaccagtccgtggaacagtaccgtgtggaacggcgcttttcccatctgctcgtaacccgagaagatcatgcggatgacccagaagaaaataatgtcgtaacctgttaccagcacatcggtcgggaagaagtagtccagatcctcggtcttcttgggccagcccagtgtcgagaacggccacagtgcggaggagaaccaggtgtcgagcgtatccggatcctgctccatgtggccgcatccgcacttcgggcacttctggggcgcactctttgccacaaccatctcaccacagtccggacagtagtaagccggaatgcggtgtccccaccagagctgtctggagatgcaccagtcgcggatgttgtccgtccagttaaaataggtcttctccatgcgcttcggcagcagctggatatctccgttcttcactgcctccactgccggtttgatcagctcatccatctttacaaaccactgctgcttcaccatcggctctaccgtcgtaccgcagcggtcgtgtgttcctacattatgagagtgcggctccacctttaccagaagtccctgctccttcaagtcgtccaccagtgcctttctgcactcgtagcggtccatcccctcgtattttcctgcgaaatggttcatcgtcgcatcgtcgttaatgacggtgatctcctctaagttgtggcgctttccaacctcaaagtcgttcgggtcatgtgccggtgtgatcttcacgcagccggttccgaactccttgtcgacatatgggtctgcgatgaccggaatctcacggtctgtcatcggaagctttaacatttttccaacgatgtccttgtagcgctcatcgtccggattgacagcgactgcggtatcaccgaacagcgtctccggtctggttgttgcgatctcaacgaatctgccttcctcgccgactaccggatagttgatgtgccagaaaaatccgtcctgctcctcatgctctacctcggcatcggaaatggaggtcttgcagaccgggcaccagttgacaatgcgggagcccttgtagatcagtcctttttcatataacttcacaaatacctcaagcactgcgtcagagcagcccttgtccatggtaaaacgctctctctgccagtctgcggaggaacccatcttctttaactggttgatgatgcggctgccgtactcgtccttccactcatagcatttctcgagaaacccttcgcgtcccagatcgtgcttgtcaattccctgctttttcaggttctcaataacctttacctcagtcgcaatggaggcgtggtcggttcccggctgccacagtgcattgtacccctgcattctcttgtaacggatcaaaatatcctgcatggtgttgtcgagcgcatgtcccatatgaagctgtccggtaatatttggcggaggcatcacgatggtaaacggtttcttgctacggtcaacttccgcatggaaatagccgttgtcctcccattttttgtaaagtcttccctcgatccccttcggatcatatgtcttggcaagttctttgctgcaattctggcacattgtcctctctccttttctttcctaattacataaaaacgccctttgtatccgtaaggatacaaagggcgacttatcgcggtaccacctttgttcaccagctgtatacagccggtcttcgctccggtcagatgctctctaaccagcggttcgttaacgggaaccgggcgtgaacacttgctgccgtacatcttctgtaccgctttctgggtgttccggttcaaaagctaccttccacgcatctccttccaagaaaccttgcagccgatgggtctctctctctgcggcgagtctgcatgtactcctctttctctctaccttttacatactgttaatgatacgtgcagcgtcccgttttgtcaagaaatttttagttcagactcttcaccagcgcctcatagacaaagcgcttcgcctcttccctgcttaccgccatcttctctcctttttccagatcgaccaggtatcctgcaaacgctgtcatctgcgccacgaacgccagcttctgcaagtacggattcgtctccccgatcgtgccttccgacacgccctggcacatcagggactccacaatcctatccgccagatggcagcccagagcctgctgtctcttttcacattccctgcgcatggactcagagacctcatacgaaccagttccgatccgtaccagaagacagaacgcctgtcgcttcgcgaacacctcttccatataagtaagaatctgtacaaattttcctgcaaaatctccctcacctttggtgatttccagtacgtgcgcaagccgcatctccacatcgtagaggaccgcattcgcaatgatctcctccttggaggaaaaatactcgtacgctgttcctttgccgatccccgcctgcgccgtgatgtccgacaccttcatgcggttgatatcccagccgtcggttaccatggcaagcaccgcctcgtacagcagccgcactttctccggcagtgccccgttttcatatctcccattcattataattcttcctccaccatatttttctccctgttgaacgcgtcatagatacacggaaccacaaacagggtcagaagcgtaccgtaaatcaggcctccctcggtcacaattgccatcggctgcatcatttccgaaccgtcaccgagtccgagcgccatcgtggacatcgacaggatcgtcgtgagcgctgtcattaagatcgggcgcagacgcgtctttgctgaatttaagatcgcctcttttttcgtcatgccgcccctgcggagctggttgatgtaatccaccataacgataccgttgttgacgataattcctgcaagcatgacgaatccgatcattgcgacaacactgatctcatttccggtgaaaaacagggcaaacagacctccggtaaacgccagcggaatcgtgaacatgatgatgaacggagacaggaatgactggaactgtgccaccatgatcagatagataaatacgaccgccagaatcagcatcaggtacaactgctgcatggcatctgctatcatctcatcctcacccgtcatctcaattgagtatccttccggcagatctattttattcagttctttcatcagtgcgtttgcgacaagcgtgacgttgtgtgtgtcatccacacctgctgtgacgctgatatagcgcgtctgggaatccctggacactgcgtttaagctgctgccagcctcaaacgtcgcaatctcggtaagtggaatctcctttaccgtatccccggtatccccggtatcttctgtgtcttcgatatccttggcatcccctgtatccttggtatcctccgacagtttttcgtccgtctctttctccccgttgctacccgtactgcttaactgcgccatcttatcctcgtaggaaaacgtgaggttcttaatatcgtcgagcgtcacattcgcctgctcctcgctccttacatacacctcgtaatcctgcacgccggcagagatcgccgtcaccgcggtctgggacgccaattttgcatagaccagctggaatacctgcgctgttgtcatgccgtattccgctgccttttccttgtcgacatgaatcgtgtaggactgcgtcgtattatccagcccgtcatccacatccaccgttccttcctgtgcttccaccacaccggccactttccctgccagttcctggagggtgccaaggtcacttcccttgatctgcaccgtaataccgcttccgaggaaggaactcatatccgacgccgaattgtccgtgtcaacctgacagtccatatctttggtcagctccgcaatctgcgccgtgatctctcccgccgtgacggaggaattctcatccagaagcagatacatcgtcacactgtcactgctgccgcccatggacatcagggcgctgtctcctccggcgatcgctccgatcgtctccacgccgtcaatgcccgcaatcttctccgtcacctcatccgcgcgctcgcagagttcctcaaacgtcagtttttcgtcctccttcgccgccactgtcacggtcaactgatcggtttccatattcatatccataaaggaaaatcctctggaatacgcggcaagcgcactcgtcacaagcaggacagtcacaccgatgaacacgaccggtttgaacctgagtgccagttccaaaagcttcgcatatccctgctgcactttttcaaagaaggcgtgccgcacctctttgggatttttaagtagtcccgccgccatcatcggcacgaacgtcagcgccacgatgaggctggctgtcaatgtaaacgtaattgtgagtgcgatgtccacaaacagctgcctcgtgattccctctgtgaacacaatcggaacgaacacacacaccgtcgttaaggtcgatgcaataatggctccggtcacgccgccggctccctcaaccgccgcctttttgatggaatatccctcgctccgcaggcgatagatgttctcaatgaccacgatagagttatccacaagcataccgatgccaagcgccagtcccgacaacgagataatgtttaaggaaatatttgaaaaatacatcaacaccaccgcaaaaataacactgagcgggatggagcatgcaatcacgagcgtcggccggatgtcttttaaaaacagaatcagcacgatgacggacagcagcgcgcccacgatcatattttccaataccgactgcacaatgatatcgatataaattccctgattcatcaagatcgccgtgtgaagtgcgggattatctgcctccatcgcctttaatttctgctggatccgctttgtcacatccccggtcgagtacccggtctgcttttcaatggaaagcatgattgcggggtttccgtttaccttggaataagactcaccggcgttgttcaccagttccactgccgccacatcgctaaggcagactggcccgattccgtccagaccaagatcaatcaaaaccacctgctttaattcgtccacggaatccagcttatcgcccacacgcaccatgtagcggttctcgccttccccgacatagcctgccggcatggaaaaattctgtgccgcgagcaggttaccgagcatgtcgaccgtgagaatctgatccagatccgcagattcctttgcgctatcctttgccgcatccagctggctctgtccctgcgccagctgattctttgcatcggcaagctgcgctgtcgcctcgctcagctgcaggattccctcaatctggttcttcgtcagctgcgcggaggcttcatccagcgcaattttacctgcgtccacctgtttttgcgcctcctgcatggtcgcaattcccgtattgatctcggcaagcttctgcgtcatatctgcgattgcatagggcagatcatcgagtgtctgtactttgatgccaaggctctccagctgctgtccccatgcggcgatcgattcattgattgttgcaagctgtgcatttgcctgctgctcgatctgtgcgctgcctgccgcaatcgcctcctgctgttccggtgtcagcatattcttcagcgcttccagctgctgtctggctgcaattccatcattataaagctgctgcagtgccggaattgccttctccatgatcttttttgcctcagtcatcatggtcatattcgtctttaattctgatgcgccgacatacgcctgaatctttccattttcaatctgattggctgcggcactgacctggtttgccagttcgctcttgccactctccagctttttctcgccattttccagctctgcggatgcatcatccagttccttctgcgcatctgcaaactgttcctcgatcttttcctgaatcttatcattcagagcatcgattttgtcctgatccatggtcacctgcacggattcctcaagcacgccggtagcgcttaccgaagccacaccctccacgctctcgagtgccggtgaaaattcattttccacataggaagacacctctgactcatccatgccttccacatccgccgacgccaccatgaccggcatcatatccgggtcgatctgcataatcatcggctttccgacgctgtctgaaaaacttccctccagctggtccagcttctgctggatctcaatcagaatggaatccatgttggcgctctgctcgtattccagaataaccatggaatagttgtcgtacgatacggagctcacgtttttgatgctggatgtcgtcgccatggaggcttcaaccggtgccgtcacatccgtctcaacctcctccgggctcgcgcccacatccgttgtaattaccagcgcatagggcaggttcatatccggcagcagatcagtcgtcattctggtaaatgacaccactcccagaacgatcaccaggattacacccacaatgacagtgtacggtctttttacactaaattttgaaatcacatctgtatcctctctttgactttgtattccgtccgaccagtcggtcggcttttgacattttttatgctgcgcgagaatctttcgattctccgcagcatatctgcgtttgtctattctgctgtcttacgatacttattcttcctcatcgtcgtcatccgcaattgccgccgctgttccggctaccgaagaagccaccacaaccacgaccacaattacaaccagcagcaataagatccccataaagatcaaaaaacccgtctctgtcattctccttctcctcgtctttctgtcagcagatgccgcacatcccgccgcacctcttccggcataatctcactcctgatgcaagtatagcatatttacacccgcatgaaaagtcctttatccggcctgttttgtgaagaacttctgtgtgaattccgccctgctgcaaggttttccgaacagaaacccctgtatataatccggctctgtctgttttgcctttgtaagttcgccctctgtctcgattccctcaacgcatacgtgaagccccaggctgtgggacatctccacgatatgatttaaaagccggtactcatattcacggttcagcgcttttaatgtgaacgaccggtcaatcttaatatatgcaggctttaaatcgcttaaacaacgcaggttggaatatcctgtgccaaaatcatccagtgccagcaatacaccgtattctttgagtccgttccagactttgtcaaagcgctcattctcctccagataaccgctctctgtcagctcgatgcagacactcgacggcttgactccgaactcatcaacaatcctgcgcacatccgtgagaacacggctctttaacacctgcacataggacaggttaacattcaccttgaactccggaagaatcttctgccattccctgcatgcatccagcgcctggcgcagcacccacctgccgaccggaataatcagaccggattcttcgagaatcgggataaattcgccgggcgataccatcccaccctccggtgaatggaagcggagcagcgtctccgccccggtcagttcaccgtttgcagcatttaccaacggctggaaatatgcctcaaatccctcaaatccattatttaccgcatgatgcagctgccgcagcagtgtgcggcttttcagataatcttcgtattcctcctcctcaaatacatagcagctgttttttccgcgctccttcgcctcgctgagtgcaaactccgaaagcttcatggcattttcaaaggaattgtccacatcgccgttcttcacgatacctccggacaccgtatacaccgctttgtactggttctgctcaataaatgcgtagatggatttcttgatctcatggaaaagatcttcggcctgctgcacactgccgccggaaaaatccacaactgcgaactcatccgccacaatatggaacaggctctgttccgggcctatattttcctcaatacactgtgccgttcttcttaaaatataatctccgtattcgttgccgtggctctcgttgatgttcttgaaatcatcgatgccgattctgagcaaaaatccctgtggcagctttggactgcggctctcataaaaaatcttcagactatattctcccaacaggccgctgacattgtccgccttctgttttgccccgatctcattgatgcagcccacaaggtatctgggtgatccatcctccggatcgctcaatactctgcccctgcagttgatccagatcgtttcatgattcttccccatccagcgatagtgcagattgtggaatactttcctgcccgtggagagaagctccagctctaccagcagcaaatcaagatcatccggatatacaacctgtctgtgcatttccactacattgtgaaaatgatctgccggcagacaaaaacgcttcaccgcattcggtgaaatctggtaataatcttccttaaaatcacacacatacaagtaatcatccatacaagggcttaaaagccctaccatatcaaccatttgttccgtcgtaaaatgcgccacttccgccttcatcttagcacccccagatcccgcatctatcgtactttagtcttactccatactacataattttctgaaaaaagtcaatcacagggcagaatatctgcacaacagataccgggatgttgacgatgtctccacaaaataaggctgtcacgcgaacggacggctatgtcatatattacactgaaaaaatcggaaaggacaacgttccagatcaaacccggagcgtggacattcggagcgcaaaatacggaatttctaattctgccgtgtttgccatctgcgatgatccgtgtctttccaagttttgaacactccacgaggagatgttcgcaagccgcagacaattttagaactttcgtgtgtgccttgtggcacgctaggaagttcgctcattgtctgcagcttgtcggacacctcctgtggattgtcaaaacgtggcaaagacacagaatgagatgaaaaacacggcagaaaagaatttcacgtattttgctccaacgaatgttcacgcccgggttcatccggaacttgagccttcccgtcttttaacagttgcagcttatcacaatgccatcgttccgtgtgacagccacattttttaacccttcacacttccgagggcaacaccctgcacaatgtgtttggagaggatcagatatacaacgataaccgggaatatggagaacgcgatcatgacgtacacctgccccatatcgaacttcagccagtctgccgcacgaagctgcgcgatcaggattgggagggttttcttcttgtcatcgtgtaaaatcaatgccggtgtaaagtaattgttccagctgcttacgaatgtgaagatcgcctgaaccgcaatcgccggtttcatcagcggaagtacgatctgattaaaggtatggaactcgccggagccgtcgatacgcgccgcctcgatgagggacagcggcagagcgctttccatgtactgtttcatgtagaaaaatgtaaccggtgctgcgatcgtcggcacaatcagaggaataaaggaatcctccagatgcatctttccaaccagctgtacgaatccaagtgccgttacctgtgtcgggatcatcatgatcatcaggatgaacggatagatgaactttttcagtccgaaatcatatgcatgaatcgcgtaagccgtcatggttgaaaagtagaccgaaaccagtgcgcttaagcctgctacgataatactgtttaacataccgttccataccggaagtgttcccgcgagcagattcttccagttctccagaagatgcgagctcggtgccagtgtgaatccggactgcagctgtccgtttgatctcgttgcattcacaaacaggatgtagaaccagaacagacagaaaaacgaaataatcgtcaataccacatatgcaatggctcttcttgtatgaatattcattcctttatgtacttctcttgtttccatacagctcacccctttctcttgtcattgccggtaatcttaaatactacaagacttaatacaccggtgatgaagaacaatacaactgacaacgcacccgccataccatagttcttactgtacagatgcttattcaagaacataatcagcgtcatggaggaacgcatcggatctccggttccgtttgtcaaaatctgcggcacatcgaacagctggagaccaccgatcaaggaagttacaagtacatatacaaggatcgggcgcagcagcggcagtgtaatcttgaaaaatacctgcatggaagtcgccccgtctacctcggcagcctcaaagagggaggtatcaattcccatcattcctgccatgagaaggattgtcgtattgccgaaccacatcaggcaattcatgaatgcaaccagtcctcttgtgcttccaacattggaaaggaatttgtaaggtgtatcgataaagccaatctgcatgagcagtgagttgataggaccgctgtcagaaaacaatgtgaagaacaacatggcaaatgcagatgccataatcaggttcggcagatacatcactgtcttaaagaaccgctgtccttttaatttcaggctcacatccgagaaccatgcgcccaaaagcagtgacaggaagatctgcggaataaaacacataatccacatcaccatggtattcttggcataaacccagatgtcaccgtctgaaaacagctttttatagtttgcaagtccgacaaaattcggtccgatctgtgtcaggcccgacagataattctcaaagaaactgttgtaaatggttgttaccatcggaatcaactgaaaaatcacatacacgataataaatggaagtaaaaagatatagccccatttattataccgaacggcttttgacttctttttcatagcatttgcccccttcttttataattgccggatacgcgttccggctggtcttccgctcccggagatccatcggaacccctatcctttgtatacagagctcacagcagcccttcctttttttgcagacctgctgtcagctctgcatttctacacagattacctgtattttgacatagaatgagccacacccgccttcctgatggccggcaggcgtggctcctgtcattctatccttcgcatctttttctggcatccatcgatgcgtcagctagtgatgctcattctctcagttgctgagattacagttccacgattagtgtgtcagttccggatatttctcctctactgccttgtagaacagatccagtgcctcatccttcgttgcgttgccctcgaagtagttcttcattgcgttctggaactcctcgttgcagccctggtcatatgcggaaaggttgcttaagtcaagaccgtcaacacctgcgcagtacatagctaacggattctgtccgcctaataccttgctggagtagctggtgtcttctgccatagcttccattgtggtcttgttgtttacaaagtcatcatctgcaacaacgatatccttcatgatatcagcgttggttgtcatctgaagcatgatatcttttacaaggcttgggttatctgttccgtttgctgcacagatccatgtaccaccccagaagaatccctgcggtccctgtgttgcgccccatccgccgaggtttgcgatactgccttcgtcctcagctgccatggagaagtttactaaccaggccggtccaaagtagcagaatacctttccttccggatagaagcctttcttccagtcatcgctccaaagctctgctgtgctggtctcgcctgcatctacaagctccttggaatcgtcaacccatttcatgatgttgtcatcgatcgtgatcttgccgtctgtaacccacttggaagatacgttgttagagtatacacggtaagaatcgtttgcggaagatgtgatcttgtaaccggcatcttttaattttgctgctgtgtcattgaaagtatcccagtcttttacatattcctgtacatctgcaggatcatcagatccgagaacttcctttgctgcttcgcggttgtagaataatacgcccgggcagccctgccacgatacaccctttaatacgccgttggaatcggtaacgatatccttggtgtactgatactgatctgccagatctgcatctgtgatgccgagatccttcacagccatcgtgtaatcggtatctacatatttcaatgcgtaatcagcctctacaaggaacagatcgatcttgtcatcagctgctgcatctgcctgctttaataaggtagcatccaggttattctggtatgcgttgtcatcgttcggtgtgatgttccattttacggttacatcaccgatggttcctgtggttccgtctacgatggtgtagcccggataatgatcttccagtctggacttaaactcctcattccagcagtagatgttgaggactttgccttcatcggatgctgttgcatctgtagctgcctctgtgcctgcatctgctgcaggtgctgcctctgttgcaggagttgatgctgtgttgtctgttgtcgtcgtgtctgctgtgtcggatgatccacatcctgctgccatggatgctaccatggatgcacataagagtgcgctaatgattttcttcttcatagaaaaccctcctccttaagatgtctggctttcgccattggtttgggaaaccttttcctgcgccccgctgttatttctgcaaaaattttcctacggattgccctggtactaagcttccttctataacgactctctcaacgagagttgttcgcggtttttcaattgtgccaatcaatcgcttggctgcttcgcttccaatcagctctgtgttctgacggattgtggtaagtttgggatgtagcagctgtgagatgcgcgttccatcgtaacctgccacggagatatctctcggaatccgaagtcccatctcaatgatgacattccttccgccgatcagggcggtgtcatccgggtagatgatgcaggtcggcacatcagcgagatttaaaagctctctggtctgccttgctgcttccttcgtctcaagataatcggcagtccggatatattcatccggcacctccagtcccagttcatccatcgtccggtaaaagcttgccagccggtccttggtaacataggaattctcctgaccgtggatatatgcaattttccggtgcccctgctggtaaatatacttcacaaggtcttctatgccctgaatgttgttggagcttaccgccgtacagttatgatgtacatagtcgatcgttactaccggcagatcactgttcatcagttccaggacgtccggatcattgtaatcggcacagacgattgcgactccttcaaagttccggtatctgcagtgttcataataggacatcttgcggttctcaaaacaggtattgataaatgtgatatcgtacccctgcttctctgcctgaactttaagaccgttgagcacgcccgagaaatattcatgggtaagaccgctgcccgcctcttcctcaaagaggactcctatattataggaacggttggtcttgagtgctctcgctgccgcattgggaaaatacccgagtgcttctgctgtcttcttgatccgatgcttcgtctcttcgctgacatccttctggtcgttgagtgccttgcttaccgttgcagtggagacaccgcatttctcagctatcgtttttaatgataccattgcgtcctccacactttcgaaacatcacttaatcgttttcgtacttttactatatgctatcttttgcaaaaatgcaatacatatttgtcatttcggcgagtttaacactttttttgctgattttttgtgcatatttgcttgttctgtttcttttgcttctattataagttgtattttccctatcattcttacacgttttcgctttttatgtctatatttccagttttaacggctttgtatctttcttccatattttgcccgcttttttgttcaatctgccattttccttgcatttaagagtattttaattgatttttttatttttacagtttatacttttaggtagaaattgtttacttaatcgttttcgcaattatttcaatctgaacaattcacttacctattttcgtaacggacgtttcggaaatgcgtatgcttacatgatatgaatggaggtaagcccatgaaattcggctattttgatgatgcgaagaaagaatacgtcatcacgtctccgcggacaccgcttccgtggatcaactatctgggatcaaaggatttcttttccctgatctccaacacctgcggcggatacagtttttataaagacgcaaagctcctgcgtctgaccagataccgctataacaacgtcccgttcgacagcaacggtcattactactatattaaggaaggcgatacaatctggaatcctggatggatgcccacaaagaccgagctggattcctatgagtgccatcacggcatgggatattccaccttccgcagttccaagaatgatctctccgcagagctgaccgcttttgttccggtcgacgacagctgcgagatcaacaagctcacactcaccaacaacggcagcgcgccaaagacgttctccgttttctcctacgtggaattctgcctctggaacgccatggatgacatgacgaacttccagcgtaatttttccaccggtgaggtagaggttcacggttccgcaatttaccacaagacggaataccgcgagcgccgcaatcactacgcgctctatgcggtcaacgctccgatcgcaggttttgacaccgaccgtgattccttcctcggcgcatacggagagaattccgctcccgaggtggttgtcaccggtgcttccaaggattccatggcaagcggctgggctccggtcggctcgcatcacctttccgtgtcgctggcaccgggcgaatctaaaactttcgtgttcgttctcgcctacattgagaaccccatcgaccaaaaatgggtcggacgcccggaggacggcgtgatcaaccgcgcaccggcagaagccctgatggcgcgctacgacaccaccgagaaggcggatgccgcacttgccgcattaaaggaatactgggacaaactgctctcccacttcaccatctcttcctccgaggagaagctcgaccgcatggtgaacgtatggcaccagtatcagtgtatggttaccttcaacatgagccgttccgcttcctattttgagtccggcatcggacgcggcatgggatttcgtgattcctgtcaggatctgctcggtttcgttcatctgatcccggatcgtgccagggagcgcatcctcgacatcgccgcaacacagtttgaggacggaagcgcataccatcagtaccagccgctcaccaagaagggcaactccgacatcggaagcggtttcaacgatgatccgctgtggctgattgcgggtgctgccgcctacatcaaggagaccggcgactacacgatcttagatgagatgacgccatacgacagtgatccttccaaggcaacagacttcatggagcacctgcgccgctccttccactacacgatggagcacctcggtccgcacggtctgccgttaatcggccgcgctgactggaatgactgtctgaatctgaactgcttctccaccgaaccgggagaatcgttccagacgttcggtccgtccgaaggtccgaatgccgagtccgtctttatcgccggcatgttcgtgcgctacggaaaagactatgcggcaatctgccgtcacagaggcatggatgacgaggcagcggttgcagagaaagcgatcgccgatatggagaaaacggttcttgacgccggctgggacggtgaatggttcctgcgcgcctatgaccactacaagaacaaagtcggttccaaggagtgtgaagaaggcaagattttcatcgagccacagggcttctgcgtcatggcggagatcggtctcaaggagggcaactgcttaaaggcaatgcagtctgtcgagaagtatctcgacaccaagtatggcattgtcctgctgcagccggcttaccacagatatcacgtagaacttggcgagatttcttcctatccgccgggatacaaggaaaatgcaggtatcttctgccacaacaatccgtggatctcaatcgctgagacggtcgtcggacgcggcagccgtgcatggcaggtatacaccagaacctgtcccgcctacatcgaggacatcagcgaaatccaccgcaccgagccgtatgtctactcacagatgatcgcgggcaaggatgccaggaatttcggggaggccaagaacagctggctgaccggaacagctgcatggacattccttgacgtctcccagtatattctgggtatccgcccggattatgacggactggtgatcgatccgtgtattccgtcctctctcgacgactttaccgccagaagagatttccgcggtacgacttaccatgtgactgtcaagaacccgaaccatgtggagaagggcgtcatttccatgaccgtcgacggcaaggatgtcgatgtatccggcatctccggcggcatgattccgatcgcactcgcggacggaaagaaagacgtgaatgtcgaggttgtaatgggataacccgctgaggcttttgtcacaaagaattgtcgcaataaacatagaccgctttgggagtgataagtaatattataagaaacacacttgcggatttcgtgtggaaatgcagatggaatattcgttagagaaaaatgtgagtatttcttccggtcgaatgtttgcatcagattccgtgtctcttccacgtttggacaatccgacgggtgcatgtccgacacaccggagacaatgggcggactttctggtgtccctaatggcacctcttcacagacaatataaaaccgcgcgaaccgaactcgccggcatctgctattgaaaatagggcagatgccgactcagacagcggcttcgcgcggttatgttttgttcagaggtgcccataagggacacacacaaaagtcctacaaattgtcttccgggatgcggacatgacccgcggagtgctccaaacttggaaagacacggatcatcgaagatgcaaacatccggctggttagaaatgccacattttttgatccgaatttccacctgcatttccatctgaaatcccacggtgtgatcttataatattacttatcacacaaaagtgactatgcttattgtgacagttcctttaaaaaaagcctcatgcggtcttcccatggaagaaccgcgtgaggctttttcacatattcgctatcgcttagatcgctgtcacaactccgttttcgctgtcaagctctacataagcgctggactttaatacctccagtgcgttcttcgcgccgatcagtaccggaatatccaggctgagtcctgcaatcgctgcatggcagctgtcgctgtccgcctccacgatgagaccggatgcctgacgcatctgcttcatcatgcagttgttggtatctgcagcaacgatgatgtctccctctttgaagttcgcaagatcttcctcgctgtggcagacgcacaggtttgctgcaatcttcttacctgcaattccttttccttttaccaggatatgtcctgccacctgcaccttgatgaggttggtcgttccggatacgccaagcggtacgccggcagtcagaacaaccacatcgcccttgctgatcagacctgccgtctctgcagtgtcaaccgcatagtcaaacagttcttccgccttattcttctgctcaagaagcagcggtgcaacgccccaggaaagtccgagctgacggtatactttctccgtcaggcacgcgccgatgatcggagagtacgggcggtacttggagatcatgcgcgctgtgcgtccggacttggatactgccagaatcgccgccgcattgaggtctcccgccatcgtacaggttgcatgggaaatcgcgttcgtcacatccgggctgctcatattcttacggtccttgaaacgctgcagatagttgatatcgcactcggtgcgaaccgcaatgcggaccatcgtcttcaatgcctcgatcggatactggccggcagccgtctcaccggaaagcatgatcgcacttgttccgtcatagattgcgttggcaacgtctgtcgcctccgcgcgggtcggacgcggatgtttcatcatggaatccaacatctgggtcgccgtgataaccacttttccggcaccgctgactttcttgataatcatcttctgaatgacaggaacgtcctcaagcggaatctctacacccatgtcgccacgggcaaccatgataccgtcggagacgcggatgatctcatcgatgttctgcacaccctgcatgttctcgatcttcgcgatgatatgaatgtcctcgccgcctttttcctcaagaatcttgcggattgcaagcacgtcatccgcgcagcgcacgaaggatgccgcaatgaaatcatagtcgttctccaccgcaaatacaatatcgccgtagtctttctcgctgatgtacggcatggaaagctccacgttcggaacattcacgccctttttattggaaaccataccgccgttcataacggtacagacaatatccatcggcattttgccctctgcatccgcctttgtgcccgatactttctggatcttcttgacttccagaccgatcagtccgtcatcgatcagaatggtatctcccggcttcacatcgtccggcagatccttgtacgtgatcgccacacggctctcatcgcccacgatatcctccgtcgtcagagtaaatgtctgtccgttcttcagctccaccttgccgcttgcgaactctttcagacggatctccggcccctttgtatccagtagagccgccaccggacgcttcatttcctctcgcagcttgcgaagcatcgtaagtcttccaaactgctcctcgtgtcctccatgtgaaaagttaaagcgcgccacattcatgccttcctcgatcaggctgcgcatcacattctcatcatccgtcgacggtcctaacgtacatacaatttttgtctttcttaacataatattcctctctttattctgtcactttattttgtaatcatggtgcccatgcccggagttacctggcttccatccacatgaagctttgtaatcaatacggagcggatcgccgaatcaccgataaagtcgatcgcagcctgaatcttcggctgcatatccccttcgccgaactgtccctgctccatatatttctttgcttccgccactgtcatggaattcagcgggcgttcattctctgtgccgtaatctaggcacacattgtctacgcttgtcaagatcacgagcatatctgcctccagaagctctgcgagctttccggctgccaggtccttctcgatcactgcacttgctccctttaagttattgtcctgggaaagaaccggtataccgcctcctccgcaggcaacaacgatctgatccgcatctgtcagtgcgcggatcgcatccatctccacaatatcgaccggcttcggcgctgccacgatacggcggtagccgtctgccaccttcgtcacatggttgccttttttctcctctgcctctgcctcttcctccgtcatcacacggccgatgatcttgctcggcttgtaaaatgcctcatcgtacgggtcaaccaccacctgtgtcaggatcgtggataccgtcttgtagatacctctgttcagaagctctgcacgaatcgcattctgcagatcatatccgatatatccctggctcatcgccgagcagacagacatcggcgtcgccgtatattccggatacagacggcagaactcattcatcgccgtgtgaatcatgccgacctgcgggccgttgctgtgcgtgatgaccacctgatagtcctcgcggataaaatcagcgaccgcttttgccgtgcgcttcgtagcttccttctgctccggcagtgtcgttcccagtgcgtcatgtcccagtgcgataacgatcttctttttcttcatttttatcatcctccaacgcttttatgcgcgcatttgtaatcccttttccctgtatacaccaaaaaattttaccagttttattttatcacgaaccctctgtcatgcgcaatgggcaacttgtcacggaagcgttaaagtttgccgcaccagaacgcaaaaagcgggaaccgcacacacgtttttcgtatgtgcgattcccgccctgtgttttctaatctcccgtttttccggccggaatttaccggcttcgtcttgcccaaacttctgcccggctcctattcgtcctgcggcaggacaagcgaatcgatcagttcccagatctcctctctaccctgcttggtctccgccgaaaacggtatgatcatcgttcccggctgcacgccgagtccctcccggattgccttgacatttttctgaatctggcttcgcttgatcttgtccagcttcgttgcaatgatgatcggggcaaatccctgatacaccatccactcgtacatcatccggtcgttggcagacggatcatgccggatatcgatcaggagaaagaccgccttcagacgcttggaggtgtgaagatagttctcgatcattttcccccactttgccttcacttcctcggacgccttggcatagccataacccggaagatccaccagatacatggcgtcattgatgttgtagaaattgatcgtctgcgtcttgcccggctgtgcggaggtacgcgccagcgccttccggttcatcagcgcattgatcaatgatgatttcccgacgtttgactttcccgcaaatgccacttcgttgtaggccgtatccggtatcttgctcgtaattccgcagacaatttcaagatttacatttttgatgaccatgttctactccttcttttcgcaaaaagcgacgcgaagcacctgctccatcgtctctacatagacgatctccagtccctttttgatctcacctgatatttcctcgacatccttctcgttcttcttcggcacacagaccgtacggacgccggcgtttttggctgcgagcagcttttccttcaagccgccgatcggcagcaccctgccgcggagcgtaatctctcccgtcatcgcaacatccgcccgcaccggtgtcccggtaattgccgagagcatcgccgtcgccatcgtaatgccggcagacggtccatccttcggaaccgcaccttccgggatgtggatgtgaatatcatttttctggaaaaattccgccggaatgtcatactgtccgccgaccgaccggatatagctgattcctgtctgtgccgactctttcatgacatcgcccagctgaccggtcagctggaattcccccttgcccggcatcacgttgacctcgatctccagcgtatctccgcccacgctcgtccatgcaagtccgcgcacgatcccgacctcatcggtctcaccgcgcatatcctggctgtatttttccttgccgagatacttctcaagattgcgcaccgtcacatcgaccgtgctgctttttccttcgtagatctcgcgcgccgccttgcgcgcaatctccccgatcctgcgctctaacccgcggactcccgcctctctggtataaccgcttatgatcttcgcgagggctccgtcgctgactttgaactgatcttcctttaagccgttgcgctccgtctgctttgccagcagatgttctctcgcaatgtgaagcttttcgttctccgtgtagctagttacctcaatgagctccatacgatccaatagcggtctcggaatcccctgcatggagttcgccgtcgcaataaaaagcacctccgaaaggtcgatcgggagctccacatagtgatcccggaacttatgattctgttccgaatccagcacctcaagcagcgccgaggcagtgtctcccttatagtcactgctcatcttgtcgatctcgtccagaagcatcagcggattcttcacaccggcgctgcgcagaccgttcacaaggcgtcctggcatggctccgacgtaagtcttccggtgtccccggatctccgcctcatcgcgcacaccgccgaggcagatccgcacgtatttcttatccagcgcacgtgccacagagcgcgcaatgcttgtcttgccggttcccggaggtcccaccagacagatgatcgggctttctcccttgctcgtcagattgcgtaccgcgagaaactccaacatacgctccttgactttctccagaccgtagtgatcttcctccagaatccgctctgcgtttgcaaggtctttgttgtcctcggacgctttattccacggaagctccagcagcgtctcgatataaccgcgggtcaccgcgctctccgatgaattcgcgctgatgctcttgaagcggtcaatctccttcttgatgcggtttttcacttcctggtcggcatccagcgcatccagtgctttctggtactcgtccgcatccgattccgtattgtcctcgccgagttcctcccggatgagcttcatctgctcgcgcagtatgtattccttctggttcttatccacgcgctctttgactttgctctggaattcattctggatggcagtgatttcaatctcttttaaaaggagcgccatcaatacctcatagcgctccgtaagtgtcattgcctccagaatcttctgcttttcttcgtaagaaaccggcagattgttcgcaacctgatccatcagcttcggcagatcctgtatggtaccgatctggcgcagcaattcttttccggcacgcggatttactgtctgataccggctgtatgtctcctgtacactgcgcaccatcgcagctttggtctcttccgaaagcccctcctccggcagcacgcacggcaccacctctgccagaagatacggatccgtctgtgcaaaagccgaaagttcggctcgctcgataccctcaaccagaattcttacgatattgttttgtaatttgattacctgctttacttcagcgatcacaccgatatggtatacatcgtccgctcccggttcttcctgttcgacattcttctgcgccgacaggaaaatcttctgggaatccatcatgcactgttcgatcgcacggatggaccggtcacggctgatgtcaaaatgcgcaatcattcccggaagaatgaccatcccgcgaagcgcaaccgcaggtatttttaagatttctgtatccaacatatcctctatttttcttctatggtctttaatttctgctcctcaatggaaagcttctcctccaccagatccttggtgatctcacactcggtgatgctctcatccgacggaatatggtacatcagatccagcgtcacagcctccataatcgcgcgcagtcctctcgctcccgtcttgcgctcgagcgccttgtcagcgatcgcctccagtgcgtccgcgtcaaatgcaagcttcacgccatccagctcaaacagcttctcgtactgtctggtcagcgcattcttcggctcttttaagatgcggatcagggcgtcgcggtctaacatatccaaagataccgtcaccggcacacggcctatgaactccgggatcagaccgaacttcacaaaatcctgcggcagcgcatgcttcaacacatcgccgatattgtactcattctttgacttgatgtccgcgttgaaaccgattgccttctgatccatacgcgtctcaatgatcttctcaagtccgtcaaatgctcctccgcagatgaacagaatgttcgtcgtatcgatctggatcagttcctgttgcggatgctttctgcctccctgcggcggtaccgatgcaatcgttccctcaaggatcttaagcagcgcctgctgtacaccctcgccggatacatctctcgtgatagacacgttctcggacttcttggagatcttatcgatctcatcgatatagatgataccgtgctgggcacgctcaatgttgtaatctgccgcctgaataatcttcaagaggatattctctacatcctcaccgacataacctgcctctgtcaacgtcgtggcatctgcaatcgcaaacggcacatttaagacacgcgccagcgtctgcgccagcagcgtcttaccggaaccggtcgggccaagcatcaggatgttgctcttctgcagttccacgcccagatcgtcccctgccataattctcttgtaatggttatatactgcaacggaaagaacctttttcgcctgatcctgtccgatcacataatcgtccagaaaggcttttaattcttccggttttaaaaggttgatctgctccgtctcttctgcggtgccggtctcttcctcgttctcaaactcttcctcaataatctctgcacagatgtccacacactcatcacagatatatgcccctttcggtcctgcgatcagcttgcgcacctgtccctgagattttccgcaaaaggagcagcggatctcatcatcacttcttcctgccatttttaactattctccatgttctatcttacttcctgccaaaatcaggtcttatttgctttcttccttcttggtgtccttgcggatgatgacatcgtcgatcagtccgtacgcctttgcctcctcggcagacatgtagtaatcgcgctcggtatcggcagcaaccacatcgtacggcttgccggtgttggcagcgagaatctcatttaactttttcttggtctttaaaatgttctccgctgcgatctggatctctgtcgcctgtcctttggctccgccggacggctgatggatcatgacctccgcattcggaagcgcatagcgcttgccctttgttcctcccgcgagcaggaatgcacccatgcttgctgcaagtccgatgcagatggtggacacatcacacttgatgtactgcattgtatcgtaaatcgccatacccgctgtcaccataccgcccggggagttgatgtaaagctggatgtccttgttcggatcttcggactccaaaaacagcagctgtgccacaacaaggcttgccgttgtctcattgacttcctctccaaggaaaataatacgatcttttaacaggcgggaataaatatcataattgcgttctccgcggctggtctgctctacgacgtaaggtactaaactcatattcgatcctccattttatacttttttaataattacttataagcttaaacagaccggcccaatagagccagtctgtctgttttgcaataagaactgacaggggaattactcctctgttccctctttctcttctgcttctttttctttcttggattttgctttcgctctctccttcacgttctccatgatcaggtctactgccttggtcactgcaaggtctctcttcatggattccttctcgttgtcgccgatgtactctttgagcttgtcagcttccataccgtactgtgctgccatcttctcaatctcagcatcaagctcttcatcggtgatctcgatcttctcatcctttgcaatctgctctaataccaggctgctcttgatgcgtgtctcagcttccgggcgaacctgctcttttaacttgtcgagtgtcagaccggagaactgcatgtactgctccatggaaagaccgctctgtgccagtctctgagcaaattcattgaccatgttctcacactgtgtctcgatcattgcctccgggatctccatggtggacttgtcaatgatcttctggattgcctcgtcctccttggtcttcttagcctcgttctccttctctacctcaaggtgcttcttaacgtcagccttgtactcctctaaggtatcgaactcggatacatcctgtgcgaactcatcgttcagttccggaagctccttgcactttacttcgtggatcttaaccttgaacattgcaggctttccggcaagatctgctgcctgatacttctcagggaaggttacgtttacttctacttcgtcgccggcattcttgcctacgagctgatcctcgaacgtatcgatgaaggaatgggaaccgatctcaagcggatgattctcacccttgccgccctcaaatgcaacgccatcaacaaatccctcgaagtcgatcactgcggtatcgccgtttgcgatcggtctgtctgtaacggtaacagttcttgcgttgttatttctctctttctctactgctgcctctacctcttcgtcagatacggaggtatcgatcttggttacctgaacaccaagatacttgccaagctttacttccggtcttacagcaacctctgctgtgaagatgaaaggcttgccggactcgatctgtaccacgtcgatggtcggtctggatacgatgtcaataccgctctcctctactgctgcaggatagttctcctggatcagggtgtttgctgcgtcctcatagaacactgcctcgccgtacatcttctcgatcatctttctcggaactttacctttacggaaaccaggcatgctgatcttgcctttttctttcaggtaagcagcctggattgctttctctacttcttcggcagccacttcaatggtaagctttgccatattcttttctaagttttctacctgtacactcattgtaactatcttcctccttaatatatatgaaatatcatgtacatcttccgtccatcgcatgacattcgtcacgccagtcgcctgcagcccttttttaagggttcctgcctgtctttcggaaaaaagggcgtactacgactatcacagtcatttaaggattataacatacaagaccggaaaatactagcttttttttgatttctttgcggtttttccgccaaaaacacgccctagagctccacaccgcgatgttctacagaggtagagaacacaatcagcgtctttgtccgtccaaaatactgtaattccccgataaaacggtcgagttccatcgtattttcaaacaaaacctctaacagcatggaatagtcgccggtcacacagttacactcaatcacgtttttgcacttttttatatagcgaatgatggaggttctgtcaagccgcatccgcttttcgctgcgcggctttcttactctctcacccggcttcgtactgcttttttctcacgggtttttttcacggtacacccttccgcctctctcattcggcttcgtactgcttttttctcacggggttctttttccgctccacgctccgcagctgcttcttccgcgcggtctcttcccgtcgcttcgcatgcgccgcctccgccagaagcttcttatagttaagcagccggcgttccggcagtcttccgtcccgcactgcctcctgcaccgcacaccccgtctctttttcatgtctgcagtctctgaatctgcaatgctgcgccaattcctcaatatccgaaaatgtcgtatccatcccgcattttgcatcccctacgccaagtacgcgcattcccggtgtatctatgacacgggagccatccggcagaaggatcatctgccggtaagtcgtcgtatggcgtcctttggaatcatcctcccggatcgcgccggtatccataaccgtctccccacacagcgcattcacaaacgtggatttgccgacaccggatgatcccagcagcactaccgtttttcccgcacccagatagcgttgcacgtgttccatcccttcgcccgttaccgcacttaccgcacacactgcaactcccggcgcctgcctctccacaagatttacataatattccggttcctcgcagagatcttttttcgtcagtatgacaaccggcgtcgccccgctctcccacgcggctgtcagataacggtccagccggttctggttaaaatcatgattcatcgacatgaccagaaacacatagtcaaagtttgccgccaccgcctggcgctccatgccgggcgtcggattttcccggtaaaacacgctcgttctgggaagcgtctcaaggatcagtgcatccccgcaccggtttgtctgaatacgcacccggtcacccactgtcggaaatgcctccccgcccttgtcctgataatacacaccggtctttaacctggcattaagctttgtatctgacgtttcctgttccacaagaatctcataacgttctctgtgtaccgctgtgatcagtgccgtcgctttcgtattttctgttttatttcctgtatgttccatccgttttcctctttcctctcaattttccattcactgtttctttccattcctacaatctccattctgtttttctccatttttacattcctcctttattaaaaagaatctcgcttgcgagattctccgcacgcgagcggttcgcaaagcgatattttccttaccgcgagctgcgcatcctcgcggagcgttttttatttcataggaaagttccactttcacacatgaatgtatcacggtatttcctatgaaattaaaaagcattcctgccacattcctgcaccgcaatgcttctgccttcattcattctgttttttgtgccggattgccgtttccagattgtaaaaagcaatcgacggcttgcaacacccatttttcaataagcattgccggcttgcaacatccatttttcaacaagcattgccggcttccagtctccgggttttccaacataatcgcagatttataccaggcgcttcaccataaagtgatcgtccgcatagctgccgtcccgataccggacactgtgcggctgcgttccccagatctcaaacccgaggctctcgtacagtcggatggcaggtgtgtttgtgctcaccacttcaagttctgcctgctcatatccgcactgcttcgccaccgtaagcaccgtctttagcatttccctgccgattccgagcccgcagtatttctgatagagggcaatcgcaacactgcagcgatgcgcatagcgctcataatttcccagagacatcagggaacagtttccgacatgttctccagcaacggttccgatcaacatcagttcccgcggttcttttacgattccttctataaaatgttcctcctgctccggtgtaagactgatctcatccggctcacgtatcagaaatggcgtctccccggcagtcactttcagataccggatcagatcatttgcatccgtcactgctgcactgcgcagaatacagcttcgcccgtcccgacaggtaatttctcttggttcataaatcataattgggtctcctccctgtgatctgtatcactccggcactttattttttccacattttcttccgtgatcgtcaaaaagtcgatctgcacggtatcgctgccgccgcaaatcccggcaaaaacaggtttctctgacacgatgcgtcatgatagtcccggcttttccgctttttgtgcatccaccggaatcggtttttcctcttttatgcatccaccggaacatgcttttcctctttttgtgcatccaccggaacatgcttttcctcttttatgcatccaccggaacatgcttttccggtgtcagaccttacctggatgcgtttgcatgtattacgcatcctttagatcgattcctgcttcccgcagatttcttcgcagttccggcatatcctgatgataaacgcatccccgcattcccaggcgtatccccgcttcaatgtttgccggcgagtcgtccacaaaatagctttcctgcggctcaatcttcattttccggaagaaatccacatacgcttcgcgttccggcttcagatatccacactcacacgaaatccagatgccgtccatataccctacagacggaatattttttgaaaatgcccggaaacggtgtgatgtatttgacatcaaaaacaaatggtacccctgttccttcaactctcccagaagcgcctccatcggcggattcggctcctgcttcatccgaaactccctcacgaaacgctccacaagctcccactcactctgcagaattctcttgcaaatggaacgtaccgcttcctcatcggtcattgttcctctgtccatgcaaatccactccaccgatgcacaaacctgatttttcaacaatgctgcctgcgcttcatcctctgtatatgtcccgatgtaatcgctcagcttatattttgtcagaacatttcccatatcaaatacgatatttttcattttatctccatattccgttgacctgctgcgtcacattgttccggcgcatgcgcgtactcttatctttctatgtcgatccggcgcatgcgcgcactcttatctttctatattgatctggcacatgcgcattgcatcaagcgctatctcgtggcttttcggcgttacccctgcacagcaggatgcatccacgataatcggtgtctccggcaaaaatgctttcaataacaatgcatttgagatcacacaaatgtccgtgcagagtccaaccagcgtaatgtcctcgatctgctcttttctattctcctcctgcagcaactcgccaagcttctccgaaccgaatgtcaccttatcaatcgcctccgcctcccggagcgcctctagctgcggacagatctcccagcctttcgtgcccttgatgcagtgcggcaccggaagatgttttccctcctgtgtctctaaataccgctctccatgtgtatcccgcgtgaaaatcacttttcccggaaactcgcggattttctgctccacccgtgggacaatggcgaccgcctccggtgttccaagcgctccattgataaaatcattctgcatgtccaccacaatcaatattttctgcatcttttctcctccttctgaaacttcgcgggtctcacggtctctttttcctctctcagacccgcagggcacctctttttcacgaatttcttctgtttttcgctctccgcgggtctcacgagctcttttttctttcctagacccgttttttctcttttttcgggtctcacggtctctttttcccctctcagacccgcagggcacctctttttcacaaatttcctctgttttttcgctcttcgcgggtctcacgggctctttttcctctctcagacccgcagggtgaacctttctaactcggctgcagaccaggtccacccttccaactcagttgcagaccaagtctaccgttccagcccaaccgcagccgcaacgcctcatcttccaattttttattccagccccgcgaactgcgccatgtaaagatcgtaataagcaccttttttcttcatcagctctgccggacttccctgctctaagatgcagccctggtcgatgacaaaaatgcggtctgcattctggatggtcgaaaggcggtgtgcaatcacgaaactggttctgccggacagcagtgcctcaattcccttttgcacaagaatctcggtgtgtgtatcaatactggacgttgcctcatccagaatcagaatcttcggcatcgagatcatcgtccgcgcaaacgcaatcagctggcgctgtccgatcgaaagtcctgctccatgttccttcaactccgtgtcataccctttttccattttcataatgaactcgtgcgcattgacggccttcgccgcagcgatcatctcctcatccgtagcgtcaagctttccatataaaatattttcacgcacagtgccgtggaaaataaaattgtcctgtgtcatgacacccatctgccgccgcaggctttcgatggaaatcttcgtgagatcgtagccatccaccgaaatgacaccatcctcaatgtcatagaatcgactgatcagattcacgatcgtcgtcttgcccgcgcctgtcggtccgacaagcgcaatcgtctctcccggctccaccacaaaactcacatcggaaagcacctttgtctccgccggcgttcccttatcgtatgtgaagctgacatgggaaaattccactcttccctgtacttccggcagttccgtcacgtccgccgcatccacgatatctgcctttgtatccagaatatcaaaaattcgctccgccgccgttaagtttgtcaccagattattataaaaattactcagattcataattgggttccagaacatattgatgtacgtgccgaatgcaaccagaagtccgactgaaaccttttcaaaaccgagaaagcggacgccgaccagatagagcatcatcgcgccgattccccaacagaaatcaatcaccggtccgaacatatccgcatagcgcaccgcgtccacgaacgactgctgatgctcatctgtcagatttccgaaaatctctcttgtctcctcctcggcgccaaaactctgcaccacattcattcccgcaatgtcctcatgcacataggcattgaggttggatgattttttgcggaaaatctgccagcgcttatgcgaggcagtctgcacaaaccaaatgccgccgatcatcagcggaatcgtgctgagtgatgcaagtgccagacgccagtcctttatcagcatgatcaccacaacaccgatgaccgtgatcagttccggaatcaatgttgtcactacatttaccagaacatcccgcagcgaattcacatcgccgatgattctcgccagaatctttccggtcggtctgctgtcaaaaaaagaaaacgacagcgtctgaatgtgttcgtacagatcctgacggatgcgcagcagaatcttgttcgataccaccgccatcacgtacatacggatcttcaccataatgataaaaataatattcagtcccagcgcaaacagaccgagtcccatcagacctttcatatctttatttgcaatataatggtcgatcgcctcctcaatcagaagcggattgaccagtgaaatggcaaccgtcacagccatgcagagcagcacgccgatcaggattgctttatattccagtaagtaggagaacaaccttcggaaaatcttctttttgtcagtgttctccataaattcatcttcacgataggaattaactgccatgaactctcatccccttttcctctataataaacattttcattcgctgcgcccgctcgggcggcttcgcctccctcgctgtacggcattcgccgcatccctgccgttcgcctgctctcagcagcacgctgctggtgccggctctcctgcagaggcgctgctcattgctaacgcaccatactgtgccatgtaggtgtcgtagtacaagcctttctttgcgagaagctcctcgtgtgtcccgcgctccgcaatctttccgtctgcaagataaataatctcatccgcatgacgcaccgccgagatgcggtgtgcaatgataatctttgtcgtatcgcgcagagcgtttaacgtctgctggatctcatgctccgtctccatatcaagcgccgaggtcgagtcgtcaagcaccagaatcgggccgtgctttgccagcgcgcgcgcaatgctgatccgctgcttctgtccgcccgaaagtccgacaccgcgctccccgatgacagtctcgtactgttcatccatcttctcaatgaacccgcgtgctttggcatcctctgccgcgaggcgcaccgcctccatctgaagttccttgcgctgtcccatcttgatgttctcctcgatcgtatccgagaaaaggaacacatcctgcaaaacaaccgcgatgttgctgcggagctgatgcacatccatatttcgcacatccacaccgtcaatcttcaccgcgccgtccgtcacatcgtaaaaccgctggagcagattgacgatggaggatttgccggaaccggtcgcccccatgataccgagcgtctttcctgccggaacggtaacattgatgtcctgcagaatcttctgcccgtccatgacaaagcccgcgtggtcaaaacagatctctccccggatttcgtcaagcacctttggatgctcgtcgtttttgatcttcggctgctccgcataaatcttgcggatcttcttataagatgccaccgcggacgacacatcgttcgtcagccagcccagcatctccatcggccaggtacagttcctgctgtactccacaaacgccaccagcgcacccagtgtcatctcaccgttcatgacaaaaataccgcccaggatcgtcgaacaaaccggaagcacctttcccacaaacgaaaacagcgggtaatactttgtcagtacctttgcctgtgaaacattcagttcgtaataccggttgttgtgggataaaaatttttcaatctcatgcttttcccttgcaaacgccttgactgtgcgcacgcctgcaagattctcctccgccacagttgtcagcacggcattttcctcactgatgtcctcgtaaatcttgtcgagcttgcgctccatgatgatcgcgaccgtaccgcacaggatcattgtggcaagcggcacgaacgccagcttccagttgagcgaaaacatgcagtacagtaccatggacacatgaatgataacctcgatgacaagcatgcccacatagcccatcgcattccagattttatccacgtcatccttgacacgcgccatcagttctcccgtgttcgtgtcctcaaaatatcccatggacagcgactggatatggtcgaacagatccttgcgcattgccgatccgatcttggatgccagcacgtcgaacgtgaactccttgcagtagccgaaaatactcctgccgattcccacgatcacgattccaaccagaagtttcgtcaaaagctccagttttccgcctatgatgacatcatccacaatctgctgtgtgatcttcggatacagcatatccagaacgatcgccgtcaccatcgaaaataccgcaaacagatacccataccaatagcgtccgatataggtgtataactttttcattccctaatctcctccttcttgtcagttccccggtgtcaccttcctgcaaaacaaaaaagcgagggggcatcccgttacggattctcctcgctttttgcgtaaaaaaatccgtggcatctttcgatcaccacggtctatcatcaggaatggtattgtcacattttcacgccatccgcatcttctcatacggcatgtgcattacttctgaccgttactccccaccgaggcaatcatatgattctgctttttcacttccacgacgttacttgtaattctactcataatgcttacctctctttccttaaaatttagattacatgttgtcttacaaaaaccagtatacgcatacctctttttaaatgtcaagaaaattctcataatttaccattataatatttgatttcgtgcaaataataggattaggaattacagtaattcattattgtactcctaaatcacaccggaagatgttccgggaaaacagacgacaatatggagggaaaaaccatgagtggatctagcaattctaattccggcacaaaccagatggcagtgccgcaggcaaaagaggcaatgaaccgttttaagcaggaagttgcaagtgagatcggtgtaccgttaaaggacggctacaacggcgacttgacttccgcacaggccggaagcatcggcggcgagatggtcaagaaaatgatcatgaagcaggaagagcagatgtccggcaaataaaccggcttcttctgcccattgcaccaaaaacggggctgtcgctttaagcaggcagtcccgtttggcatgagaagaaataggacaagagaatcatgcccttcgatttcagatggaatgcagatggaatattttttgtgaaaaaatgagagcatttctttctgccggatatttgcatcggattccgtgtctcttccacgtttggacaatccgacggggacatgtccggcacaccaaagacaatgggcggactttctagccgccctaactgtactccctcatagacaatataaaaccgcgcgaaccgaaactcgttgccatctgctattaaaaacaaggcagatgacaattcagacatcggcttcgcgcggttatgttttattgcgacataaggatggctgatttatgccatccggtgtttggtactggtaagggcggcacaaaagtcctacaaattgtcttcggggtgcggacatgacccgtggagtgttccaaacttggaaagacacggatcatcgcggatgcaaatatccggctggttagaaatgccgcatttttgaacagaatttccatctgcatttccatctgaaatcgtgaggcatgatcttcttgtcctattacttatcattccattacgtgtcacgccaaaaggggactgcccgtttcacgcggcagccccttttttgtgctcttttatttttcgtgcatccagacgcgcatctggtttaaaccgcggtttccccatgcaaaataagggattgcgcgaagcgtaaccgtttcttccttcggcggttcctcggtgtagagttcctccgacggcacaagccggatccccgccacatcgagcagtgtgagaccggaaagcctgccttccgtgcatacgagagcctttgcatccagttctttttttaccgcaagcgcctgcagattggctccgttgtcagcgccctcaaagcagtagaccacaggtccgcgcatcagcgccacgcatccgacgtcctcgcgtacatgcgtactcgcataaattttgcgcaccggcagtggaaaatgaagttccacctgatcgtcgcttccccattttctgctgatgtacaaatagccatcacggatttctccggcagtatcaaacgcctccccgttgaccgtcacgcgcaggtctttcacataagccgggatatgaatggcaagtgtaaagagttcgtcgatcttcgcggacacatggtaagtcacgcttccctcccacgggtatgcgctctccacgcggatgtccgccttgccgagcgccgcctcctgtcccagaaacagatgggaatacaccgccgtctcgtcctcatcccacgcatattttccaagggaggtcaccatgcggaccaggttcggcgggcagcatgcgcacgcataccagcccggacgctccggaatcacatgtttgtaaccgaaaatctcgccggacacacccggattgacctccagcggattgacgtagaaaaaccgctttccgtcgagctgcataccgctgatgatgccattgtagagcgcccgctccatcacatcggcatatcttccgttcttctccgtctttaacatatttctcgcaaaaaagaccagaccgatcgacgcacaggtctccgcatagttcatatcgttcggcagttcatactcttttgtgaatgcctcgccctccacggtcgagccgatgcctccggtgatgaacatctttttctgcgtcatattctcccagagccgtctgcacgctgcaaacaacttctcatcgtgatcctccgccgcaagatctgccatcgccgtgtacatatatacggcgcgcacactgtgtcccacagcctcatcctgctcgtagattgtcgcatggctctggttgtactttgtgtcgtccgggatcatattgccaaaatgcgtccagcccctgcgctcggtctcctccttaaagaagttcggattctttccacgctcctcgaggaaatagcgcgccatgtccttgtaggcttcctttccggtcgcatggtacatgcgcatcagaccgatctccacctcctggtgtcccggaatgcccggaatcttatcctctccgaaccggttcatgatatgctgcgccatccgctccatcacgccgagcagcttgtcttttccggtcgcctcgtaatacgccactgccgcctccatcatatggcctgcgcagtagagttcatggcactctaacagattctgccagcggtgctccggctccttgatcgtgaaaaatgtattcagataaccgtccggctgctgtgcctttgcgataatgtcaatgatgtcgtccgcgcgctgttccaacgccgcatccggcttgatcacgagcgagtacgccacaccttccagccattttgccacatcgctgtcctggaataccatcccgtagaactcaccttccatcagtcctgccgcaatgcggaaattatccagcgcatggctcttctccacgccttcttctttatcgtttaataccctctcctgaaacggtatcacagtatctgtgatcttttcctgcataccgctccagaacgggtctttgatccgaatttgctgtaatgcaatctctttgctcatctcttttcccccatcagttccgatattcacgggtcatttccaattctctggcgagatcctccggcgtcctgtacttgcggaataccttctcgagcacatagtttttcaccagtgcaaacactcccggaaacagtacaatcaggcactgtgtatcgttgcacatcagaacaaacagcacaaacacagctactaaaagcgccgaccatcccagatttgccaccaccatcacaagcgtcttcttcatggactcccgtatggttccctcaaacctcgccatatacgccgtcaggtaaaactcccacgccagcgccatggcagaaagtacaataaaaaaataatacagcgcaccaagcgccgagccctgtgccagaaactgtctggtcaccacaaggtccgccgcaagaaacgctgccagtattccccacagcagccatgctcctgtggtctgtttcaaatccgttttcagagccgtgcaatattcccggaatgcatagccctgtccatgtacaatgcttttattgaccgcatggtacaccgccgctgtggcggctcccatggtaacgaccggaatgctgcatacaatccacagcgcgccgagaatcaggcagtccgccagtcctcccagtatgcggaaaacgttgttgttgtaatcaaaaaactgattcatatgccctccattccggtctaagccattcggttattttttcagacggatgcttaccacgctgcatgccggaatctgtacccgtatgccgtccgccgtcttctcgtaatctgcaaatgcctgctccgtcaccacttccggtgcctcaaacgtgttgtgtgcattcatcgttcctgccacaacactcgcctcgcatacgccgtatgcagcgccgtcgtccgtcagctggatggtcacattctccgcagcttccagtgaattgttggtcagtgtcaccgtgatcacgccgtccgcgttctccgatacagactcaatcaccttcggcagttcgttcttgcctgctcctacggttccagcaccgatcagatcgcttctgagaagagttgctccctgatgatgacgatacatatggaatacatgataggtcggtgtcttgatcatcttctcgccgtcggtcagcatgacagactggagtacattgatgagctgtgcgatgcatgccatcttcacacggtcggaatgtttgttgaagatgttgagtgtcatacctgccacaagtgcatcacgcatggtgttctgctgatacaaaaatcccgggttggttcccggctctacgtccgtccagattccccactcgtcaacgatcagaccgatcttcttgtccggatcgtactcatccataatcgcaccgtggcggttgatgagttcgtccatgaaataacctctctttaaggtctggtagaaaatctcctccgtgaagtctgttgcgcttcccttcttattccagtcatcctccacctcaggaagtgtataataatgaagggaaagaccatccatcattccatggaaacgcggctcgcagtgatcaaagcaggtctccatcacctttttcgtccactcgtaatcatccacgttcggtccgcagcagatctttgcgatcgggtcatttccagcatagtttctcacatatgtctggtatctgcggtactcatctgcataatgctgcgggcgcatatttccgccgcatccccagttctcattgccgacaccgaagtaatcgatcttccacggctcctcatgaccgttctgcttgcgcaggtctgccatcggggatacgccgttgaacgtaatgtactctacccactcgctcatctcacgaaccgtaccgcttccgaggttgccgttgacataggtcttgcaaccaagctgacggcacagttcaaagaactcgtgtgttccgaagctgttgtcctcgacaacgccgccccagtgtgtattgatcattttctttctggatgctttcggtccgataccgtccatccagtgatattcgtctgcaaagcatccgcccggccagcgcagcaccggaatcttcatttcttttaatgcttccaccacatcggtgcgcattccgttgacattcgggatatcggaatcctctccgacataaagtccctcataaatacatcttcccagatgctccgagaaatgtccatagatttccggagcaatcgtgctcattttcttgtcgttattgatgactaattttgccatagtaacctcccgttatgtatcagtccctttcgagtttttgctgtcattgattcacatcagccctttacagctccggctgtcattccttcgatgatgtacttctggaagatcaggaaaatcaccaggatcggcaggattccgaacatggaaccggcgatcagcacatcatagttgtttccgtacggcgtcagcaatgtatttaatccgatcggaagggtgaacttttctgctcccttcagtaccagaagcggccacaggatcgcattccagcttcccattgcctgcagaattcccatggaggcgaatgccggcttcgtcagcggaagaatgatttttgtcgcaataccgtactctgtcgcaccgtcaatacgcgccgcatccagaagttctctcggaagtcccgacagatactgccggaagaagaaaatcgtcgatgcgttacatagtccgatgataattactccggtgtaggtatcgatcagatgcagtgcaataatttccttatataaaggaagcatcagaatctcaaacggtaccatcattgtcgcaattacaaggaagaagaggaaattcttcagcttgaaattgtacattgtcagtccatatgccacaaagtagcagatgaacaatgtcagaacgaccgacacgatcgtaataaccagagagttcttataccacataaaatatttctgactgtccgcatttccggaaaacaggtacttatagttatccagattcatcgtacggatatcgagatcgatcgacaatccacggcggatcagctctgttcctggtctgaaagaggcaagcagacctgcgaataccgggaagataataatcaggcttaagactgcgaaaaatcctgtgccgagaactgttcccactgtccgttttgtcttgccgctcttcgggcccttatcgccctttctgttcttctcatctgccatgttatttctcctcattcttaaatgttccatttgcaatcaactgaacgatattgatagcaagtgcgatcactaacagcaccacgccgaccgcgcatgcataacccatatcatttttctcgattccacgcttatacaggtatccaacgatggtgagtccgatgttgttcggtgagttgttgcccgcccataacatgtaggattccaggaacattgccagtccggcatagatggaaatcgtgagcacgtagaccgtcgtcggcttcaaaagaggaagcgtcacatagcggaacttctgccatgcagatgcaccgtcaatctcagatgcctcatagagggaggagtcgatcgccttcagtcctgaaaggaagtagagcatattaacacccgtccatctccaacatgcgactaccagaagagccgtcatacctgaccatcccattttcagccatttataggtgccaaggcccagtgctgcggtaataatattcatctgtcctgtcgaatattccgtgaacatcagtcgaaataatgtaccggaaataaccacggaggtcaatgccggcatatagagaattgccttccacacaccttttgcttttaccagacggctgtccatcagcactgcaaaaagcatcgggaaaggaatcaaaagcaccaacgtaaacagcatgtattttgtactgttccagattgccgtgtggaatacattatccttcaacaacttctggtaattggcaagacccacccactctgatttgattgctccgatgtcctgaaaactcattgtcacggatgtgatcaacggatagatccagaaaaacgcaaagcttaaaataaaaggtatgacaaaaatatatggcgctactttttccgaatacaagaacttttttaacttcaactcaacaccctctccttcttatgaaaacagggatgccagaggagaaccctccagacatccccattcccaaaacttatgtcctactgctcaagatcgactgcatcctgtaactcctggagagcatcagatacatccatgccgtcctcaagtacctcatttaatgttgtgttgcatacatactcgttgattgtcgggctgatcgctacaacagagatcttaccgatgttgtccataccgatggaattcaatacatcgtacggatagtttctgaagtatgcgttgtactggttgctgtcgtcatgtgcgaaagcatcatctgtccagcatgcggtgttgcatacgtcgaatcctaatgtatcccagatgttcttctcaccctcgtcagacatctttgcccagcaaaggaactcagctgcaagatctgcgctcgcagactgctgtgtcacaacggtacctgtaccaccgataccaacggagcacttctgacctgcctcaaataccgggcacttagcaatgtaccagttaccgctctcctcaggcatatagtttgtgaaacggctcatgtaccataatgccttcgggaaagatacgatgttgtgatccagaatgttctggaaaccagcctcaaggtctacatgtccatccggagaaacctctgcgaagccgctgtctaaccaggactgctgcatctctaacattttctgaacggaatcaagctgaacgtttgccggatcatcgaatccgccggtccagtcatcgccgtactcagccattgccagccataaccagtctgtaccgcctgtatctacggatgtgaagtatttgccttcctcaccgattgctgccacatactcatcaccgagtgcctgataatcatcccatgtaacaacggaatcaatcttagcagttacctcatcctcagaaattcccatagcctctgccatagctgccacgttatagtacattacggttgcacctacatggtacggagctccataataatgtccgtcctcccctgcgtaggtatccatacgtgctttaaccatagtctccatgtacggagctgcgtagtcatccagcggaaccagccactggtcaagacctgcaaccacgttcgggaactgtccaacctctacatcacagatgtccggtgcaccggttcctgcctgaagtgcggtaagaagctttgtgtgcatatcgctgtacggatatgtcgtacatgtgatctcgatcgtctgatccggatgctcctcgttccaaacctcagccatcttgccgtaatgctgtccgtgaagctctacgaatgtccacatctcaagatgtgttccgttcggatcaccgaatgtgttggtaacaacctctgactctgcggattctgttgcatcctctacagcgtcctctgctgctgcctctgtgccatcccctgttgtgcttcctgaatttgaagcagtggtagaagcatcagagcttccacatcctgcaaacagggatgtgaccattgctgcgcacatcagtgcactgaatactttccttctcatataattcttgccctcctccttgaattataggataataaaataagttgctaagatgatctgaaattcacataagatcttgtcataagctgggctcattagctatttcgacaatttctttgttcgatttcatttatcttatgtagataatatacaatgcatttcctgtggtgtcaatatttattttatatttttccaaagtatttttgcttttcgctaaattatacaaaattatgaccgacatgtcatgtgatagcgttcttgttttgtgcaacttgacatattgttttgtttttatttaaatatttttaatttcatccttaatagttgacacttttctataacaattctataataggaaactaataaagaacaccttaactagttccgtttttacaggaggatactcaggaaatgattcatattacttccttagacgatggtctggagacatttaaggctctcgggtctgacacacgtatccagattcttaatattttacttgaaaacgagcagatgagcatgaaccagcttgcgacagagctaaacatcagcaacggagctctcacaggtcacgtcaagaagctcgaagagtgcggtctgatcaatatctccaatgaatctgccggacacggcaatcagaaaatgtgttccgtgacgcaggaccgcatcattgtggacatcaagaaaccgattgattataagaatgtattcgagactgagatcaaggtcggacagttttccagacatcaggtgtggccgacctgcggcatcgccaccagcgaatccgtgatcggcgagttcgacgatatccggtactttaatcatccggatcgttttaccgccaacattctctggttcactaagggctatgtcgagtataccataccgaacctgatcccctccaaccagcggatcacgcagctttccatctcggcagagctgagttcggaggctcccggcatcgacaacaactggccgtcggatatcagtttttacatcaacgacaccaaaatcggcatgtggacgtcccctggtgacttcggcgatgtgcacggtatgttcaccccgcagtggtggccgcagaactggaatcagtacggtctgttaaagctgttagtcatcaatgattacggcacctacatcgacggtcttaagatctccgatgtcagcacgctctcgcttcacctggactacaacagcgacatccgcctgcgtctcgcggtcgagaatgactccgagcatgtcggcggcatcacgctctatgggaaatctttcggaaactacgatcaggacatccgtgtcgccatcaattatgcgccgcttgtcgctgcgcagccgtagcgggggatttcttccgggcagttgtatagatagacattagctctgaaacggttgtgggtgcagctgcgggaggtattctgatcgcaaaatccggtatttctaaccataccgcgtccggcatccttgatgatctgtgtctttccaagctttgaacactccgcaggatgtgtccgcaagccggcagacaattttaggacttttgtgtggcgcttattgccactgatgaacaaaacataaccgcgcgaagccgatgtttgaattggcatctgccttattttcaatagcagatgccaacgagtttcggttcgcgcggttttatattgtttgtgaagaagtggcattagcgccactaaaaagtccgctcattgtctgcgggttgccggacacacctgtggattgtcaaagcgtggcaaagacacggaatttgatgccggacgcggcacggaagaaatactcgcattttgctttaaagaatacctcacgcagctgcatccgcagcctctttcgttcttttgttctccatacaactgtccgggatcatgtctctcccactacggctgtgcgtcgactaccgcttcttcgggctgcggatacagctgcggcactaccacttcttcttcgggcaccgtgacacggctgccactgcgcgcagctccacatagcagccgcacgccatgcaggttccggcattcagcttcccgcattcccggcagaccgagagtctgctctcatagacttcctctgtgacccggtccgcctctttgatcgcagcgcggtatttttcaatcatttccatactgtcccccgcctcgatcatatcccgaagcagacagcgcgtacacactctcttctccatcatctcatgcccacatttctgaatttttaccggcaatcctactcgtcgaacccgaacaccggtcggccgtcctgccatctgatcttcataagcattgcgtgacggttcggattgtacagcgggttgcccacaatctccgtctccgttctcgcatggtagaccataatgtcatctcctgcctcatccttcgtgaaggaattatgtcccgggccgtagattcccgctttttcactggatgtaagtaccggatagcgctcttttttccaggagagcggatctaacagatctgcgtctgcatccgccgtcatcatacccatgcagtaatgcacgccggtatcgctggcggaatacgtcataaatactttgccgtccttctgaatgaccgccggtccctcatttacccagaagccgtggcgctcccagtcgtaatccggcgttgtcagaagaacctgcacggaatccagcgtgtagccgttcttcattctggcgatgtaaagattggatatctgcctgccgactcccactttttccgcccagatgtaataccagcttccttttacctcgaagacggtcgcatccagggaaaatgcctcaaacgagaattcgtctccatctgcacgggtcatcttgcctttttccacccacggatcatgtaccggatcatcaccctggcattccagcacatacgggcggatcgcccagatgtcgtccttatcgccgccggcatagtagagataccattttccaaagagataatgcaattccggcgcccagatatggatgctctgcggtccgctctcgtgcttgtgccatacctcatgctcttcggcatccgccagatccgcaagatgcgcggcacggcgcagaacaatcctgtcgtattccggcaccgatgcggtaaaatagtaggttccgtccgtgtgacagtacacataaggatctgctctctgcagaatccacggctcattatatttcaactgtttctccatctttttctccttataaagatccggctgagcccttgccggacgctttgctttttattctgttttattccgcgatatattttacgccccagacactctggtttccgcccacggcagaaaatgtcatcacatcggtgcctgcctcgtctttcatctggcagaacacgccgctgtagtcctctccgtcaatcgtaatgtgcatatagtacgttccgtcaacagcttcccaggttcccgctgcctctcttccgacgactgtaccgtcagcattcaggtacaggatcaccgggttggcaatgtcattgctgatattggttccctgattgatcacaaaatatcttccgaccacggcatccgtctcataaccggtaccgctcaccgtctctccctgtgtctgatacggcaattcgcacggccatccgtcctcgttcatcagcatctgatgtacgcgcggcgaatgattttccgtgccgttgttaaaacgggtatggtagaccagatactgtctgccgtcctcatcgatgaatgcagagttatgtccggtcgccatgtacgcgcgctctaaggacggaagcttgtaattgccggtcagcttcagaccgtaaagctgatgatccacatccgcggtcgggtattccccgttcatatccacataatcgccgtccacggtcttggaacggaacacgcgcacctgatagccgccgctgcttgtgagcgtaccgtaagatacatacaggtaatagtaatccgtcgcctcgtcatagaggatgtaaggtccctcaattgatttgtgtccgcctccgagcagacgctttccgtagtaggcatccacattgtgttcctcgtccgcctccggatgaatcacctgtccggtcgccggatccagctccagcaggaaaataccgccgctccaggaaccatagaccatccacatgcggtcgtcggcatcgtaaaataccgtcgggtcgatcgcattcggatattcctcgaagttataactgttgtttctcacatatttttttaatgcatattcctcgtcgacataatccagcacatcggttcctgcgattgtgtccttgtcaaaaccggaatagatgagcgctccctgccactcgtaaggtccctcgatcgtctcggatgtcccgtagcacaggttcgatgcattccaggtggatgttgtgcaatagtacatgtaatacagtccggtcgtcttgttatagattacatccggtgcccagacatgtgttttcttatcatctgtctgaatcaggctgttcttgctgccggcgtaggcgaacgcctcgtctgccacatcataaatctgaccgtaaaccggattcgtcttgttgtatccgtctgcaatggactcccagtgcagcagatcgtcactttttgctgccgacatatgggaaccgaagatataataagttccgttttcctcatagattgacggatcatgtaccgccaccccggaggaaacgtccccggtctgaatcccgtcgtagctcaccgtaaaattgtaatcggtattctccggcgtctcagactccgtcacattctctgccgcctctgtcgttccgcaggcagcaagtccggcggtcattgccgccacaagcagaacagaaatggttctccttccatttcgcataaaaaaacctcccatgatcttcattgcccagctttagctacaatatatcagataacaggaggtaatacaatatttatttttagttttattaaagtattttatattttatcaaagtttaattcaaataaaaggttgccgccttcttatcgcttccgtcggtgagcaccagtttgccgtcctgcagcgtcagatattgtcccggcatgagcacgctctcaaaggaaactcccttcttgtcggacaatccctccatcgtgtggaatgtctgcgcctgcgccgtctcctccgcggcatccacatcctgtgccagcacaacggtgccgtctgtctgtgctgtcaggtacagtcccgacttgttctcggactggatggacacgtaatattcgttggatgcatccgcctttccgtcacagagcacccatttctcatccgtcgacagatctccgagtccggttccgaccttgacatttttcatcggataatccacatccgccgatgaattgacgaatccctcgtgcgagagcagcgccccgtcgcccgccgcggactgtaacgtcactgcggtaccggcaagtcccgccgtcgtctcctcgaagtaatcgatgctgccgtcgtcattgaaatgcagctccgtgatgcatgcgcttctgcggtaaccgttgcctcccggcagcgagccgttgtgataggcaaaatacgtcttgcctttaaaatcaaagaccgccatatggttcgtgttcgaggtcgaagtcgggtacattatgacattgccgaatgtccagtcaccgctggttaaatccggcgctgtcgcatatgccatgcattctctccacccgtacgcgtaaaacagataataatctccgtagtagttgccctgttcatccgatctgcggtacagccacggcgcctcggtgtaattctcaatgccgcccttctgatacatgatgtccgcatcgtcaaacgaagtaccactggtaatctccccgtctccgttcatatccttgactgaaatcatatcctcattgagctcgcacatgaaaaacatgccgttgccccacgccagataccggtgctcctcaccgttttcatccgtctccacccacgccgtcggatcaatgtcattgaaggtggaaagctgcggcttcgtcacagaaccgcgcacaagcggttctccgatatcgacaaacgtgcccgtcggactgtccgccaccgccacaccgatcgactgcttgccggatttatcccagctgcagtagtacagataatacttgtcgttgtatttcatgacctgacttgcccaagccgatacatcatccttcgcccagtccacggtatccatcgtcatgacggttccctcagacttccagttcaccagatccgtggaggaataacacagatattccggtatctcataaacggaattcgccacctgttcgtccgtcgacgcgtcgtgtcccgtgtacagatacacggtatctccgtccaccagcaccgatggatctccgccataaatccgctctccgccgtcatccgtttttacaatcggattgctgctctccgtcctggcaagcgccacctcttttgcctcgccgcagccagtcagacctgccgccataaccagcgatgccgccactattccataaccatacatccccgggtttttccgtgcactctgccgcttccagctcccccgccatcttttcgtcgtcctgtctgtaaacatttccttctccttttaccgatctcagacgttctctgcaccgagccccgttttcacctgcagattaccatttacctgtaacgcttccatcgtacgacttgtatggtcatgtacacaagttgtattttatggagctgccgctttccgtgtcctgcccctttagcgataagtaatattataaaaagtacctgatacagatttcggatggaactgcatatgaaacattcgttggagaaaaatgtgtgtatttcttccagtcggatgactgcatctgattccgtgtctcttccacgtttggactctcccggagtgtgtccgacaagccacagacaatgagcggactttctagtgtccctaatggcaccgcttcacagacaatataaaaccgcgcgaaccgaaactcgttggcatctgctattgaaaatagggcagatgccaattcagacatcggcttcgcgcggttatgttttgttcattggtgccataagggacacacaaaagtcctaaaattgtctgttggcttgcggacacagtccgtagagtgctccaaacttggaaagacacggatcatcgcagatgcagtcaccggctggttagaaatgccgcattttttgaacagaatgttccataggcattccacccgaaatcgtaacggtgtacttctcataatattacttatcgctaaaaggagcaatacacggaaagcggcagccccataaaacacgccgcatggaggacgctgtcagacacttattactgcaccacgtgatataccagtccgtccttgatgtgctccactgccgcatcatccgcaaaatagcggacaatctcgagcgcaaacggaattgcagttcccattccgcggcttgtgatgatgtttccgtccacaaccacggcgtcctcactcgttgccgcacccgtcagcttttcctcaaaccccggatggcaggttgcgcgtctgccctccagaataccggcagctccgagaacactcggcgccgcgcagatggctgccaccagttttccctcgcccgcaaacttcttaatcacttcgtttaccgtcgcatggtcgagcagatgcagtgttcccggcattccgcccggcagcacgattccgtcaagtgcgccataatccacttcttccgctacggcgtccgccaaaaaggtcacgccgtgggaactggtcacttctctttttccgttcacggagatcatcgtaatgtccatcttcgcgcggcgcacaatatccaccacggtcagtccctcaatctcctcacatccgtctgccataaaaattccaattttactcatcataattctcctcttttctttttcttcgctttcacttttgcattcactatattacgcaatgcacgctcgaaatgctgcgcattcctcgctgtcgggctttcgccctatcaaaagagtaccacactttgcaaaaacgtgctatgatagaatcaatacacaatcaatgcatcagcatgtctgccgccagccggaacactccctgcggcagccggaaaggaattcacatggaaatcgaacgcaagtatctcgtcaagatcctgccggaccacttggagcagtacccctgcaggcagattgagcagggctatctgagcacgaacccggtcgtgcgcatccgacgcagcaatgaccgctatattctgacttacaagggaaaaggactcatggtccgtgaggaatataatcttcccctgaacgaagagtccttcacccatttaaaagaaaaaattgacggtcttctgattcagaagcgccgctatctgattccgctcgcggaaaaatataccattgagctggatgtatttgagggagcgcttgccccgctcgtgctcgcggaagtcgagtttgagactgaggaggaagcgaatacgtttgtcccgcccgagtggttcggcgaggacgtcacgttctccacaaaataccacaacagtaccttaagccagcgcaccttttcttcctgaaccggggcatcagcccaggcgccccgcctcctttaacaggcggtacaaagtcggatccagatggaactcctccatcatgcgctccacctcgccgaggtaccgcttgcggacggcggcaggcacgatcgctctcgccgcatcggatccgccttttttcactgcgcggatcagaaggttcttcggcgtatgggcaaagtctacaaattccagcacctgcgtcttatagccgcagcactcaagcagattcgcgcggattgcgtccgtggcaagtgccgcaaagcgctccttaataattccgtagcgcgtcatcagtcccagatcctccgactggatctgtccgtttaattcatgctggcagcacggcacggaaagaatcatgcgcgcgttccacatgatggcgttgtacagtgcataatccgtcgcagtgtcgcaggcgtgaagcgtcaccaccatatccaccggcgcatccgtgcggtatccgttaatgtctcccacctcaaaatgcagattctcatagccgtactttttcgcggcggcattgcagttcttaatcacgtccgctttcaggtcaagccctgcaatctgcacgtttcttttctgaatctccgtaaaatagtaatacagcacgaatgtcaggtaagattttccacagccaaaatcaatgatgtgaagtgtttctgatgtatcgtccccgaccgcatcaccgaccatctccaaaaaacggttgatctgccggaacttgtcatacatcgtgcgcacgacttttccttcgggtgtaaacactcccatatccacaagcggttctatcggcgttccctcctccagaatatactgctttttgcggttgtggctcccgcttgcctttgccgccgtctgcacattctttttcgtcttgtaggttacttttcccttttgggaacacagatatatatgctctgcagcatcatcccaggcattgacctgcagatactgccccacggccgttttccccagatattccgccagcttctcgggcggtatgttctcgtgaaatacctgtttttccgtataggctgccgcctggtaataggattccttgcgctcaatgacaatccggcggtaagggatctccccacccgccggtttgctgataatgattttatatggtttggcctgcgcaatcgcagataatttttccttctgttcttccatgtactctcctgctctcgtatctggtcagcgcatccgctgcgtctcgtagcgctgctttgtgcggatgcaggctttcaactgctcatagcggtccgccaccggtccctccggaatcacaacatccagcacaaccgccatgctgttgatgagatggtcgtccacctcatcccgcatcgacaccagaatattatatttttcttccagcgtatcagcgtcaaaaaactgcatcagcttcggattcacctcatcggaaagcgactgctccatctggcttacccggatctgatccgtcagctcttctgcctccgtctcctgcacctcgtccgcaaacgatgccgtcgcctgtgcctgcttccgcgcctcagcccgctccatgcgtccgctgccagcgcccgcaagttcgctccggtccacgcgttcaaaacggtaggtctgcgccgcatccggatatttttcacgatcgacctcgctcacaaacatggtgagcggtctcgcatatacctgataatctccgtagagagcctgataaatgaccagtttttctccggtctccgaatgtgttgccactgcgatgacctgataaagtctgtttttaaagtgacgatagatctccccgctctgcgggattctcactctttccattcctgtaaccttccttctgtccctctttgctgtcctgccgtatctttatgcacccatatccagctcataaccgttcagcattgccactccctccgcgataaaatcgcgctcaaacggcagatttgcctgataacccataatcatcagatcctccacctcatgcatcagttcactggcactgtcaatatcgatcgcgttgacgagttcgtgtgctcccgccatcatctgctgctccagttcatccccatcgttctcgctcacattctctgtggcacgttttaatatgtcattctccgcctgattaggctgcggtctgcggcagcctgccatggcagccccgcctgcactctgcgtccgctgtcccagcatctggttcgggcgcacattctgccgtcctgccatctggttcgggcgcacattctgctgccccgccatctggttcgggcgcatgccctgctgctggcgcggcatctggttcgggcgcacgttctgctgctgccgcggcatctgattcgggcgcacattctgctgtcctaccttcgtctgatccggacgcatgtactgctgctgccgcggcacattcggtttcacacgctgtccgttctttctctggaatttctttatctcacttatcaccactacaatcacgatgatccatatcagtccgcccatagcttcccccttattccaatcctcttttgttcctgtcattcatgcagagcccttcgccccacttattcttattatagtgttttcttttttgtttctcaaccagaactttcccctacggtacagttcttctacatccactcccttttttgtcttcgcgttgttattttaaatatcatcattatccaatattgcttttattttcgccttgtggtatgattttatcagattatttttccagatatggttatttaaaataacacgcaaggaggagatttcatgaagaaattatcatctgtgattctggcggacctcgtcgccagcaagagaaaagagaagtccatgacgcagcaggctctcgctgaggcgaccgggatcaaccgcgccctgatctcaagaattgaaaaacaggattttatcccgtccatcccgcagttagaacagctgggagaagtgctcggctttgagccggacagcgtcttcgccgacaccgcgcacgacaggctttcctccccgtcaccgttatgcattgcggttgccggcaccggttacgtcggtctctccatcgccaccctgctcgcgcagcacaaccatgtgacggcggtcgacattcttccggaaaaagtcgacctcatcaaccggcgcaaatccccgattcaggatgattacattgaaaaatatctcgccgaaaaagatctcgatctcaccgccaccttagacggcgccgcagcatacagggacgccgattacgtcatcatcgccgcaccgaccaactatgacagcgccaggaattattttgacacctccgctgtggaggccgtgatcgaactggttctctccgtcaatccggacgcgattatggtcatcaaatcgacgatcccggtcggttacacggaatcggtacgccaaaaataccacaccgcaaacatcatcttcagtccggaatttctccgcgagtcgaaggcgttatatgacaatctctacccgagccggatcatcgtctcaaccgactccgacgacgagcgccttgtggtcgcttcaaggaattttgcagcactgctgcaggagggtgccctcaaggagaatatcccgacacttttcatgggatttaccgaggcggaggccgtcaaactttttgcaaacacctatctggcgctgcgcgtgtcctatttcaatgagcttgacacctatgcggagacaaaaaatttaagcacacgggacatcatcgacggtgtatgtctcgacccgagaatcggcacgcattacaacaacccgtccttcggatacggcggttactgtctgccgaaagacaccaaacagcttctggctaattacaatgacgttccacagaacatgatgagcgcgatcgtggaaagcaaccgcacccgcaaagattttatcgccgaccgcgttctgcagatggcaggatactacaactacgcttccgccaacacctacaattccggcatggagcatccggtcaccatcggcgtctaccgcctgacgatgaaatccaactctgacaatttccggcagagcagtatccagggcgtcatgaagcgtatcaaagcaaagggggcttccgtgattatctacgaaccgacactcgaagacggaaccaccttcttcggaagcaaggtggtcaaccggctcgacgagtttaagaagattagcgacagcatcatcgccaaccgctatgattcctgtctcgatgatgtaaaagacaaagtctacacgagagatttgttccggcgggattagttttatacaaactcctgccgcatcggggtaaagatgtctaagaggatgccgtcttccaggcagacgcagccgtgctcaatatcgttgcgctttaacagtgcgtcgcccggtttgatgactcttctgacgccgtctatctcgaattcaaagctgcccgacaccacatatgtgatctgcgtatgcggatgatgatgcagtgcgccgaccgctccttttttgaagtggttttccacgcacatcagttcatccgtgtacgctaaaatcttgcgttccacaccctcagcacacacctcggcatcgatcctgtcattaaagttccacacctgattttttactgttttctccattgctccatctccctttctctttttggttttatctgtatgcggcattttccccggccgtctgcacattctgcctgccgcattacgatccttcttttaaaatttcttcgatgagtcccatatcatccccgcagtatttttcatataccccgtacacggcattctggaaccgcttcttttcctctgcggaaagctccaccactttcgtgccgttttcaatggcaatgctgcgcgactgctcctcgcgctgtgtccacacctcacgctcgtagagcgccgattctctggcacattccagaataatctcccggtcttccggcgacagtttctgccaggtatacgccgagcagatctgcatttccggcactctgctgtgctcgtccaccgtatagtatttcgcgacctcatagtgccgcatcgcctcgtaggacggccagttattctccgctccgtccaccacctgccgttccaggctggcataaacatctccgtaggcaatgggaatcgccgtggcgccgagcgcctccaccatatcaacggcaagatccgactcctgcacacggatccgcatgcctttcagatcctccagacaggtaattggctgcacagagttataaaaattcctcgctccggcatcataccaggacagaccgatgacatcatccgcgctgacactctccagaaacgcatctccgatctctccgtcaagcacccgccacatatggtcggaatccgtataaagatagggcatctgcagcacattcaggctcggaatatattccgcaagctgcgccagtgacacccgcgcaaaatcaataccgccgtactgcatctgtttgatgactttattctccgacccgagcactccgaccggctgcaccagaatccgtatcctgccatttgtccgctcctcgacaagctctgcaaaatacttggcacccagggtcgtcggataatcttccggctgattttccgcataggaaaacacatattccggttccatctctgtcttggagggatacgtgtgatttctccaggcagacagtgtgagcagtatcaacattccagccacagctgccgccgcgcatatccgtctcatcgctcccccgcctcctttaatacctgcgtccggtattccgtcggcgtgacgccggcaatccgtttgaatactttcgcaaaatagttggagtcacggtagcctaccttctggctcacatcctttacattgataaggacgtcacccagcagttcttttgcccttgccacacgatactccgagagatagacaataaagttcttgtcaaaacactgtttgaaaatcttgcagaaataggcgtcggagtagttcatggcctctgccaccgtctgcaaagaaatgtcgtccatataattgtgttcaatgaacgcctggatattcccggcaaccgcctgcagccggattctcgagcgctccgtatccgccgcgtcctcatgacagtcccgttcggcaaaaaccggctcatcttccttcttctctcctgcctcccggtcatccgtatgctcatcggcaatccgtatagcctccgcaagcactgcctccagttcctgatcctcgaccggctttagcagatattccatagcgcggacggcaatcgcacgcttggcatagttaaattcatcaaatgccgtaagaaaaataatactgcagtttttatctctctctcgaatctgctccgctgcctccagcccgttcattccgggcatttcaatatccagcagcgcaatctggcagttctcggcaaaaaactgttccaccgcctctcttccattgaccgcactcacaaccgcaagctcctccgggaaatatttctggatggttctggttacaatcattctctcaatcggttcatcatccgctatcagcactcgtttcatgtcatatcccccgtttcctctctgcatggaatatctataaaaattactgttcccgcattctttttactgtatatctcaaaatttccgtccgcatacatcgcagtgatccgccggtacacattgccgagaccgattccgctgtgtctggcatcgtccgtcttaaggcggctctttaactgctgcagttcctcttccgtcatcccgatcccgtcatccccgatcactatgtgcagccgcatttccttctgtctgaccacaatgcggatgcttccgccttcctccttcggggaaactccgtggataattgcattttccacaagcggctgaaaggtaaatgccggaaccatgaccagttcctgttccaccttacagtttaattcataacggatccgctccccgaagcgcatctgctgcaggtacatataatctgcaaccactttcagttcctttgccagcggaacggactgttcgggtgtctttaaattgtaacggaacagggaactgagcgccagaatcatcttttcggtcgtctctgcctcctcaagctttgccattccgctgatgacatttagcgtgttgaacaaaaaatgcggattgatctggctttttaacaattccagctttatcatctccaggcgtttctccgtctccagctttcccagctcctcctcatgcagaagatcaagagtcttcctcttttcttccagcgccataatgtactcgcctgtcgcgtatttcatcttgttgaacgcatgcaccagttcccccagctcgtcctcattctgcacctgcacgtcctccgagaaaaaatcattggcggcaatgcgctgcgccgctttcacgagcgccaccaccggcgagataatggtctggttcatcaatgccgccagctccatcatgccggttacgagaataatcccagataccacaaccacaatcggcatgcatatgagcatgggcacctttttatgatagaggccgtcgccgtcctcgatcgtctcattcatcagcgtcgccgcgtattcctcgagatagtcctgcatctcgtagacctcatacaggcgcttgatatagtccggcgcattttcccccatcgcaagcatggcgtcccgcttctggcaatagacttcataacagctcttgatcgaccaggtctttgcgtagcgctgctctccaatctcagaatagcggaacggaagcttttccaccgctcttccggttcgttctatcgcaatatccagactttctctctcctcgcgattgccctttatgtatgtctcaaactggatactctcttcctcgagcgcctgtgccagttcgctcaccgctgcgttatcctgtaaaatccggttaaagtcgatcagggaaaacttgacaacccatacattaaaaagaacagagactgcaatgatgagaaatactgtcccggtaaacgtcgctattttctttttgatcgtaagtgcctgccagaactgttttatcctctttctcacgcttgtttttcccatgcctctctgttctctctataatgcggcaaaagcaaagccgtagatacacactccgtaaatacagctttgcatatttgctttatctattctgttccactttgctctgtacaaaggaccaaaacgcctcccggtcggctcccagcacacggttggtcagcatatagccgcttccggctcccgaaagcaccagcaccatccccggctgttttgtaacccgcagccggttccacggcagatgctgtctctctcctccggttgtaacgagcagccccttttcatcaaaggtaagcctgacatcctgcggtacagccgccgcctgacgcctggctttcgcatagattgccgccggctggatgaccgggaacagtaggcatccgatcagcatcagaacctgcaggacttcccccgactgactccagaactttgccgtaagaaggatcatcgccaccgtaaataccagattacacatccccgccatggagcggtaggtctgacgcatggtaagccggaaaaaatcccatgccgtaattctgcacttatattgatattccatatgccatctcctctgtattcacaaactggctccctttacgttccaagtaacatcggaagtccgatacttaattccggtataaaggtcagaagtaataatacaacgatcatacacagatagaacgggagggttgcttttaccacgcgctccatctttacaccgctgactgcagaaccgatgaaaagaactgatccaaccggcggtgtcagaaggccgataccacagtttaataccatgatgataccgaactgtaccggatcgataccgatggaggttgcgatcggaagtaagatcggtgtcgcgatcaggatgatcggtgccatatccatgatacatcctaaaatgagcagaatcaaatccactaacagtgcaatcacgatcgggttgctcgagaatccgatgattgcctttgcagccagatccggcacatgaagtgtcgtcaggcagtaaccgaaaatactggatgtcgaaattaagatcaggacgatagacaatgtatcaatgcactgctccaggctcttccagacacccttccaggtaagacccttgtaaatatatacactgacaatcaagctgtagaatactgcgatcgcagcggactctgtcgcggtaaaccatccggctacaacgccgacaactacgattacaactgctgccaatgcccagaaagaagttccaagctgttttaacagtctcttgacactgaacttatcccccttcggataatgtctctttttcgagataatataagatccgatcattaaggagatcgcaagcagtgcgcccggcacatatcctgcaaggaaaaggcttcctaccgatacaccgccggcggacattgcatagattaccatgttatggcttggtggaaccagcagtccctcacaggaggaagtgatcgtaaccgccgtcgaaaaatcatcatcgtatccctgatctaccatcatcgggatcatgatacttccgatggaagccgtatctgcagatgcagatccggaaataccgccgaagaaataggatgcaacgatatttaccatcgccattccaccggtcatccagcctacgcaggcatcggcgagtgcgatcagcttatctgatatacctccggtgcccatcagcacgcccatcgtgatgaagaacggtacagccatcaaactaaaggaactgattccctttaccatctgctgacagatcgttgtcagcggaagtccctgcgataacaggcacagaagggaagataacgctactgcatatgcaatcgggaaacgcagcagaatcatgacaagaaagcttacgagcaacactgcgattgccatactctgtacactcattatttcgtcccctcctttacaaaaatactcttaatatgattataaattgcttccagttcaaaaacgaccatcgctacgccggcaagcggaatcgggaagtacatccagaacttggacagccacggcatgctgacgtaattacccttggctccaatgcctgtcgcatagctgaatccaacggtaatcatcacgatcgccagaataaagacggcgacatctgccagaatatccaatgccttaataacatttttcggcaggtatgcgtcaaacgccgtcatacggatatgtgcatttctgcggattgcaagtgccgccgagagcactgccatgtaggacatcagggtcagtaccacttcctcgctccatgccggatcgggtacgaaggaaacatatcttccgacaacgcagacactcgtgattacgatatctgccgtgagcagcaatttgcatacaaacagtacaaacttatatgccacatcatatgccggctttattttatctaaagtctgaaaaatcttaggcattttttcctccttaaaaaagtcggggcacgggggagcagccattctccctgtgccccttgaaaacgcacttacattattgcgggttttccttctatcaaacctataagtgtcaatctttctgtcgattactgcatatcaacgatctgctgatataactctttgttattcttggttgcctcttcgatgacatccttgcaggcatcctgccacggtgtgatatcgtctacttcaataacattaacgccgtctgcctttaactcctcaaggatcttatcctctgtctcctgggagatctgacggttgtactgggaagcatactcgccggcctcggtcagcacatcctgctgctccggtgtcagggaatcccatgcttcgtctgtgataactacctggattgctcctaaggtatgtccatcaagaatgatgttcggtgctacttccgggaatgcatttgcctgatagtttgcgatcggctgttctgctgcatctaccacaccggtctgtaatgcggaatataactcacccatggcaacaacggtcgggtttgctccaagtccttccaccatacctgtcatgatcgggtcgttggatacacggatcttcatgcctgccagatcatccattccctcgatcggattgacggtgaagaaatggcggaaaccttcctcgccgtagaacagtccgcggataccggttccgttctcatgcggctcaagcaggaactcctgtgccagatcagaggttgcaaagttccagaaatgatcgcggcttacgaatgtgaacggtacggataagagactggatttctctccgccgtagcttgtgagtgcgaatgcggaaatacgtgccatatcgatggtaccgccgccgccgagcatggtgtcgagtacatcggactctgcaccgagaacaccgtttgcctgaatatcaatcgtaatacttccgccggaaagctcttctaccttctctttgaatgcggttgctgtctgtcctacaatggttccctccagcgggtttacctctgcgtataccagagtcactgccggtccgaccggctctgttcctgtggaatcaccggcctcggttgccgctgcgctatccgttgcatctgccgttgcatctgccgctgcatctgtgttctggcttgtcgtcgtgtcggcagcctctggcgctttcagtccacaggcggtcatggaaaccaccattgctgcacataacagtgcggataaaacttttttcttcatgtaaaaatcctccttcttctcctcccgccgcgcttcatccggcggctttgtttatgtcttaattataaagttctatcctcacaatgaaaaccgtacatttttattaactttagcacatttttaacaattttaatagtttttttatatttatatggtcaaaatattctatttctttctgaaattctaacgatatacagatgaaatgcacaaaaagagccagtacattgactggctctaatatcttggaaatatcttacagtttattttgataattcccgtcctgttgctctggcatccttcacctgtcctttttcaacttttttattccatcaaacctgcatagccaaacgaacagaactccatttactccgcaaatgtctctgccaccttcacaagcaggtcgcggatcggcagatgctgcggacattgtccctcacacttgccgcagcggatacagacatccgcactgccaccgtcagcggtatgccgccggtaactgccgcggtttgtctcattgatcccgaactgcacggtcatgttgtaatcctcaaagacatccgggatcggaatctttttcggacatccctccacgcagtagcggcacttggtgcaggcgatcgtcggcatggcggcaagctcctccaccacccgggcgatcgctgcgcgctcccgctcatcaagtggtctgaactccctcatataagccgtgttgtcgatgagctgctgctcgtccgacatgccgctcaacaccagcatcacattttccagtgatgccgcatagcggatcgcgtaagatgcaaagcttgcctctggtgaaagctcctttaagatctctgccggtctgccggtcatgttggcgagtgttccgccctttaccggctccatcacgatcaccggtacaccatacttttgggcaacctcatagcatttgcgggactgcacattctccgactcccagtcataataattgatctgaagctgtacaaattccatctccggatgatttttcaggatctcctcgagcgcttctgccgtatcatggaacgaaaatccgatatggcggatgcgcccttccgtcttcattctctgcacaaacgcaaagccgcccgttttctctgtctcttccacccgtgtcttgttcatggcgtgaaacagataaaagtcaaaataagtcacgccgcagcgcgccagctgcctctcaaagatctcgctgtagtcctccatgttctgtaccagccacaccggcatcttgtctgcgagaaggaagcgctctctgtcataacgctccaccagacagcgacgcactgcctcctccgacttctgattgtggtaagggtatgccgtgtcaaaatagacaaatccctgctccatatagcggtcaatcatcctgcagaataccgcgtcgtcaatctcttcgctattgccgtttgcaacgggcagccgcatacagccaaacccaagcttcttcggcatgatctgttttaaatcttccataacacatctccttctacatcgtgcagaactgctcaatctcttccgcaatctcagaaagtcccgttctccagaaatccttctttgtgaggtcgattcccatcattgcgccagcctcctcgatcgtgcagcacggggttgccgaaagcattgccttatatttcccaataaaagcctccccctctttttcaaactggctgtaaagtccaagcgcaaacagattgccaaaagcatacgggaaattgtaaaagctcagtccctcgctgtaataatgtcccttgcacacccacatatacggatgcatgcattccgggtccagcccgtcgccgtacgtcttcttctgcgcgtccagcatgatctgctttaaatcgtccgccatgaggaacttattctggctctgttcaaatactgccgtctcaaacagatagcgggagtaaatgtccacgatacactgcgtctgctccttgatgtcgttctccagcagattcaaaagctcctctccggatgcctctgcccgggctgcctttccgagatgcacctcgttaaaggttgatgctgtctcggctaccggcatcgggtagtcctgattaagcggtgcgtgattctcgatctggcggttgtggaatgcatgtccgagttcatgtgcaagcgtgtcaaccgatccgaaataaccgtcgtaattggtcagaatccggctctgttttaaccacatggctcccgcgcagaaagcaccgccctcttttccttttctcgggtagaaatcgatccactcgttctcaaacgcttcccgcatcagatctgccatctccggtgtcagctttgtgaatgtatcaataagatactgcttggcctcctcaatgctgtaggtcttatctgccttgccgagcggtgcaaacagatcataccacggcaggccgttgacatgtccgagcatcccgccctttttccgcagatacttgcggaataccggcaggtattcgtcgatcgccgccatcatagcgtctaaagtctctcgtttcatgcgcgactgctctaacgtcatggcaagtggtgaagcatagcctctcttttcgctgagcatcgtcacctggttcttaatgtaattcagggaaaacgcgatggcatcctccaccttctcataagcggcaatctccgcctcataagcgctcttgcgcacggaagcctccgggctgtacgctaagtttcttacttccgacagtgtaatctgctttccctgataatccacttttaccgtggaggtcagataggactgcagcttcgaccacgccgcgccgccgctcatgttcatggaggcagccatctcctccacttcatcgctgagcagatgctttgcctctttctgcttctctttcaggtaaaatgtatgctcacgcacaagcccgctctcttttgccagcgcatccacgtcccggattcccgctaaaagctttcctgccgcggcctctaacggtgccatttttgcctgaagcttcatcagcttcgcattttctgccatcactgtgccgtcctctgtattgacggactgtctcaattccacatagagcgataactgatagaaaagctgtgcgatcccgctctgcgccgcaagcaccttctctgtcctttccttttcctgcatccttccggcatctgcaagcagtgtggcgagcgcatcgatctgcgccgtaagctctgccacatcctttccatatgccggatcatcaaatcctttataaagttcgtctaacgaccattctgttgtcattattcccctcctgtaatgtttttgcttcccaggacacctttcctgtgaagcgaaaaaagtgtcccaccgcttgcatgcggcagaacacttttattatagcatggattctatttctggtaaatctgaataaaatttgtgaccacttccacaagcttttcatagctcatggacgtcgtgtccagacagaaattataatttctggcgtcattccagtctcttccggtataatagcggtaatattccgcgcggtacttgtcgattttctcaatccgtctctccgcttccttctccgagaggccgttctggttcatcactcgtgcgacgcagtccttcttcggcgcacagaaatacagtttgatgacatccggatcatcccggagtaaataatccgcacaccggccgataatcacgcaggattcctgcgctgccagctctttgatgaccttcgcctgataattgaacaggttatcatcggacacaaaatccgaattctccggcggaatcacaccacccttgtacggatttttcttcaaaattccaaacaacggagaccgcttcaaccgctcgtctgcctgtccgaaaagtgcctcgttgatgccgctggcatccgatgccattcttaaaatttccctgtcatagcagttgattccaagctgctcagccaaaagctttcccagtgttcttccaccacttccatagcttctcgcaatggtaatgactgtttttttcattccattctacctccctgcattttccgtctattctcccagatatgccttcttaatagaatcattgttcatcatttccttcgcgtcaccggagagaacaatatttccggtctcaagcacatacgcgcggtttgcgatcgcaagcgctttcttcgcattctgctccaccagaagaaccgtcgtaccgctcgctgagatctcccggatgatatggaaaatctcctccacaaaaatcggggaaagtcccatggacggctcatccatcagaatgatcttcggcttggacatcagggcgcgccccattgcaagcatctgctgctcgccgccgcttaacgttcctgcaagctggttttttcgttcttccagacgtgggaaactcttgtaaacctttgccagcgattccgcaatctcgtttttgtcttttctggtataagcgcccagcttcagattctcgtagacggaaagttccgcgaacacgcgccgtccctccggcacatgcgccattcccatcgatacgatcttatgtcccggcaccttcacgatatcctgtccctcaaaaaggatctcaccctcggatggctttaacattcccgttatcgtctgaagtgtcgtcgtcttccccgcaccgttcgctccgatcagcgcaatgacttccccttcgtttacttcaaacgagatccccttaattgcctgaatgacaccataatgtactttcagattttttacttccaacattgccatagtcgttcctccatctatctcatgtcattctccaagatatgccttgattacctgcgggtcatgaagtacatcacccgtcgcgccctccgcaagtacctgaccgaagttaagcaccgtcagcttctcacagataccggacaccagtttcatatcatgctcgatcagaaggattgtcatatcgaactcatcccgcacaaaatggatcgtttccatcagctctttcgtctcgttcgggttcatgcctgccgccggctcgtcgagcagcagcagctttggattcgttgcaagtgcacgcgcaatctcaagctttctctgctttccgtatggaagattggaggacaggaaacccgcctcgcgctccagatcaaacacttttaataattccattgccttctcatccatctccgcctcaaccttgcggtatttcggcagacgtaagattccggtcagcgtcgagtaggacatctggttgtgcagtccgatctttacattgtcaagcacgctctgatccttgaacagacggatgttctgaaatgtacgcgcaatacctgccttgttgatgtcgatcgttttctttcctgtgatatccgcaccatccaggctgatagttccctcatccggcgtatacacaccggtaagcatattaaataccgtcgtcttgccggcaccgttcggtccgatcagaccgtacaactgtcctttctcgatggaaatatgaaaatcatctaccgcacgaagtcctccgaaggagatgccaagattctttacctctaacattgccataactatactgcctccttctttgtgtttttgcggaacttctgtgccattttctgtctccattcaatgcacttcggagcccagttgaaaagcatcatgacgatcagcacgatcgagtagattaacatacggtaatcggacagtcctcttaacacctccggaagaagggtcaaaagaacggctgcaatgatggaaccacggaaattacccataccaccaagtacgacgaataccagaatcatgatggacatattgtaaccgaagttcgccggcgtcgccgtaaccgtggaaaggttgtgcgcatagagcacgccgcccgctcccgcaatcgccgcagagatcgtgaatgccatcagcttgaacttggtgatgttgatgccgacagactctgccgcaatacggttatcacggattgccatgatcgcacggccgcttctggaattgaccagattgtatacaacaaataaagaaatcagaattaagatcacgcccgctgtaaagctggagagatgcggaatctttgcgattcccttcgcaccgttaatcagccagacaccgtcatctgcgagatcaatcgcgtttccgttcgagattgcaaagtggaatccgcttccgtcttttgcgatataaagaacgttgatgatatttttgatgatctcaccaaacgccagcgtcacaatcgcaagataatcgccgcgcagacgtaagaccggaatgccgatcagaaatccgaagaatgccgccatcgcagtgcccacgagcagcgcaatgataaagagcactatctggctgccgatcacaccttccagcatcttggtgcagaaggcactggaaaaagctcccacacacatgaagcccgcatgaccgatactcagctctccgaggtatcccacgcacagattcagaccgatcgccacgatagagtaggtgcacatgggaacgagcagtccctgcatcagcgaagaaattgctccggcagctaccatgatctgaaccacaatatataccgcaatcaccaacacaaaggtgatcagctggtcttttgtttttttattcaccgtttttaaatttaactttgccatagctgttctcccttttgcattatactttctcatgaatctgttttccaagaattccggtcggttttacaagaagcacaacaatcaaaaccgcaaatacaatcgcatccgaaagctgggaggatatgtaggcacgtcccagaatctcaataattccaaggagaattccgccgatcagtgctcccgggatcgatccgattccgccgaaaacagcagccgtaaatgctttgatacccggcatggaaccggtgtacggtgtcagcgtcggatacgcggaacagaacagcacacctgcgatcgccgcaagtccggaaccgatggcaaaggtcagggaaatcgtcgcattgacattgactcccatgagctgtgccgcatctttatcctcggataccgcaagcattgcctgtccggctttcgtcttcttaatgaacatcatcagtgcgatcataatcaccacgcatgccagcacggtgacaatggttgtgccggaaatggtcaacgcgccgtctgccagctttaaggaaggcagggacacaacggaactgaatgatttcgtatccgctccaaacagcagcaatgccgcattctgcaggaaatagctgacaccgatcgctgtgatgagcacggcaagcggcgttgctcttcgcagcggcttgtaggcaattttttcaacaacaattccgagaacggtacatacgatgatggagagaaccaccgccggaagcgggctgatcccctggccgctcattgcaaggaacaccacatagcacccgatcataatgacatcgccatgtgcaaaattcagcattttcgcaataccatataccatggtatagccgagtgcaatgatcgcatatacgcttcccagactgattccattgatcagataggataagaaattcataacaacacctctgtctttccttgtttaatacgttaaaacgtcagcagtttcacttattataacatgttacatacctgtatacaacttaaaaccgaaaaaagaagaggttccgcgccggcgggtagtcgcccccgccaacgcgccaacctctttattggcctttcctgcctgctctattacattgctgaataagcaccgtctttgattacgactgccttcggcgccttgctgacctcgccggttgcctgccatgtcatggaatcaccagtcaaaccgtcaacgctgatctctgccatagccgcctcaagtgcactgccaatatctgccacgctcatatccggtgtcacgcctgcctgctctgccgctgctttgataatgtagattgcatcgtaagcatctgctgcgaactggttcggtgtatccccatatgcttctttgtactttgtaacaaaggactgtgtcttctcatcatctgcatctgctgcaaacggtgtcaagagcattacgccctctgccagctctgtgttaaaattctcaacaccaagcagtccgtccagaccgtcgcatccaaagaatgtcggagcatatcccatgctgtctgcctgtgtcaagatgatggatgcctctgtgtagtagatcggaaggaatacaagctctgcacctgcgctctgtgccttctgaagctgtgtggagaagtctgtcttggaatctgcggtaaacgcttcttctgcaacaacttcaagtccctgattctgggcttcttttacgaagttcgcctcgataccggaagaatatacatcggaactgtcgtagatcactgcaaccttggctgccagcttgttctcaccgatatactgtgcggatgcagtaccctggttcgggtcggtaaagcatacctgaaatacattatcattatcgattacatccgtggaagatgcggacggtgtcagttcatacatgccgtcctctgcggtcttctcaacaactgccacgcagggagtcgttgtaacggtacccatcagcatctgcataccccaatcctttaaggagttgtaagcattgacggatttctcggcatcatgctggtcatcctcaaacttatatgcgatctgatatccgttgataccgcccgctgcgttaatctcatcaacagcaatctgtgctccgttcataactgctgtaccgtagatcgctgctgctccggtagtcggtccgataccgccaatcttaaatgccgcgccatctgccgctgcggctcctgcgctctctgtacctgccgctgcgccgttatctgtggtcgtaccggatgctgctccgtcggaagagcttccacagcctgccatcatacttgcagccatcgctgctgtcaacaatacactcaatgctttcttcataatattgtcctccctcaagtgcctttatcttttctgaaataatagcaaaattagagatgattcacaatgttaaaattacaccaaattcttgatttattttatcgtatgattatgcaatttgtctttttcaataaccataggttatattgcgtattccaggcggctatattgtccgttcttctgcattttttaactgtttgacgggctttcttccgtgttgtaaatatacttgcgcgtcataaaacgcaccatctgctccgcctctgcccggcggcacagttccagaaaccggttccagaaacgctcgccgcagtaatccaccagatagctgttgcgctgcgcattctccatctcccgcaaggatccccggttctcatgtccgagataatatgcaagcgcgaagaaatccggctcctcccagcctgtcgcatccttcaataccgccgccacattctcaagctcactccgaagcatgatcgctgccagcttgctccccgcctcggtctgcgccttcgccgcgtgctcctcatactccgctaccatctgttttaagctctgaatcgtggactgaaaatcgagatcgtcatcccggatggaacaatcatgatagacctggtccagatctcccatcagctcgtccaggctctttttgacttcacttaccggactttccttcatgcactccaacagacgctcaatcgccgccctcgactgcgcgaggtgccttctcgcctcctcatactgttcccgcagagtatccccctgttccagcgccgcctgataatccctcagcgcctcattcacatacgccttctcgccccccgcattcagaagactcttttttaaatccttcaactccccttttagctcttttgacttctttcctttcgcagctctgtcaaacaacatttccctcgctccttctcccgatctgacatttctaccctttattatataaaacccatccgtcatcttcaagccaatttcaagcgaagaggctgacgcttcaagcggcagcctcccaggatagataagtaaataggataaaaagatcacacctctcgatttcgatggaatgtagatggaaatccggatcaaaaaaagcggcatttctagccagccgaatgtctgcatcttcgatgatccgtgtctttccaagtttggagcactccgcgggtcatgtccgcatcccggaagacaatttgtaggacttttgtgtgtgtcccttatggcacctctgagcaaaacataaccgcgcgaagccgatgtttgaattgccatctgccatgtttttaatagcagatggcaaagagtttcggttcgcgcggttttatattgtctgtgaagaggtgccattagggacaccagaaagtccgcccattgtctccggtgtgtcggacatgcacccgtcggattgtccaaacgtggaagagacacggaatctgatgcaaacattcagccggaagaaatgcacgcatttttttcaacgaatgttccatctacacttccagcgaaatcgaaaaatgtgatcttttatcctagtacatctctttcgacgccagctgtccgcctgaagcggcagcctcccgtctatttttcatcatagagatgacattttaccttatgtccgttgccaacatccttgacctgcggctcctcgtgcttacagatctccatgcactcactgcagcgggtgtggaacttacatcctgcaggcggattggccggggaaggaatatcgcccttcaaaaggatacgttcctttctgacatccggatccggcatcggaatcgcggaaaacagcgctttcgtgtacggatgcaacgggtttccgaaaatatcggccgtctcgccggactctaccatgccgccaaggtacataacgcccacggtatcagaaatatgctctacgacagacagatcgtgagagataaacagataggtcagtcctctctccttctgcagatcgcgaagcaggttaatgatctgtgcctgaatcgacacgtccagtgcagataccggctcatcgcacacgatgaattccggattcagcgcaagcgcacgcgcgatacagattctctgtctctgaccgccggaaaactcgtgcggataacgatccttgtgatactcctgtaatccacagtccttcataaccttggtgatataatcatcaaactgctccttcggcacgagtccatgctcacgcactgcctcaccgatgatctcaccgatcgggagacgcggagacagggatgaatacggatcctggaaaatgatctgcatctttgtgcgcagatcgcggagctgcttcttatcgtacttgctgatgtcctcgccattgaagagaatctcgccgtctgtcttctcgatcagacgcaagatcgttcttccggtcgtggactttccacatccggactctcctacaagtcccatggtagtgccgcgcttaatgttaaaagacacgtcgtcgaccgccttcacactgcctgtcgcaccgccgaagaaccctcccttaatcgggaaatactttttcagatgagacacttcaagaatattgccgctctgattggttgtctttgttgcttcgttattgctcattcttcgtgtctccttccttgccgactgcctccgccgcacagcggtagcagcttacaaaatgtgtcggggaaatctggtacattcccggatatgctccctcacagccgtctacgcacatctcgcagcgatccttaaagtagcagtagttcggcatatcaattgggttcggaacgcttcccggaatgctgtaaagcttctccgtatatttaccgaccaccggctttgacttcatcagtccgatggtatacgggtgtctcggatctttgaaaatctcgcgtgccgttcctttttccacaacacgtcccgcatacataacgaccacgtaatctgccatctctgcaaccacaccgagatcgtgtgtgatcagcatgatggagctgttgatcttatccttcagtccgcggagcagatcgaggatctgtgcctggatcgtcacatcgagcgctgttgtaggctcatcggcgataatcagacgcggattacatgcaagcgccattgcgatcatgattcgctggcgcataccgccggaaagctcgtgcggatacatccggtatacgccttccttgttggcaatgccgaccatctcaagcatctggatcgtacgtgtcttgacgtcatcctttgtcatatccggattgtgaagtgcaatgacctcatccacctgctcgccgatacgaagtaccggatttaaggaggtcatcggctcctggaaaatcatggacatgtagttgccgcgcagcttctgcattacagaagtcggcgtgttgaccacattgtatacatgatcgccggtattaaagcggatctctcctcccacggtctgaccggatgggcgctgtaccagctgcatcagggaaaggcttgtcacggattttccgcagccggactcacctacgataccgaccgtcttgccctgcggcacatcaaacgatacaccatcgacagacttgaccgttccgatgtccgtgaagaaataagtctgaacgttgtcgaactcaacgcagttctccggattcttcatctttgtcacatattcctcctccggaatatgctttctgtttctttttttctcgatctcctgcgtaatcttgcggttctcccgcgcaatcgcgcgggattcttttgcggagatataatttgcgtttttcttcttattattaaatgccattcctgtcacctaccgtttcatcttcggatcgaatgcatcacgcagaccatcaccgataaagttatatgcaagtaccgtgagcaggatcaggacgcctgccggaacccacacgaataaatagttcgtcataacgtaagagtcgttgaccgcattgatgatacttccccaggaagccgccggatacttgataccaagacccaggaaactcaatgtggactcggcaagaatgacatcaccgattcccatacttgcgaatacgacaagctgcgggataacattcgggatcagatgtctgaaaatcctacggcttacgcggataccggttgcctctgccgccgtcatgaactcctgctctcgcagggacaagatctgtccgcggataatacgggcaatgctgacccagccgatgatactcatgacaatacacagcatgtagatacgtgtctttgccgaagccttgtagtaatccatgatcgaaccgaggatcagatacagcggaatcgccgggatacagtaaacaacatcaaccacacgcatcaggagtgtgtccacccatccgccgaaaaatcctgcgataccacctacaatgataccaatgataagctcaatgataactacgacaaatccgatcataagggaaattcgtccgccgtacatcagacgcgccagaagatccattccgttgccatccgttccgcacagatgctttgcagatggtgccgcataactgtcgatgacacgcgtctcctgatagcgctgaatcgtatactgaccgtttttatccttgatcagataggtgtcggtctcaccctgctcgtccgtatactcaaaggaattctccccggcagtcattgcagcctcagctgcctccttgaacgccggtgtcagcacgataccactggaaaccggattcatgctcatatcagatacataagcataatccgcaccgtctgccgtatgaatcatggcagcgctgccctcgttttcaaccgtgtagttcacgccgtccgcctcaacgttcttatcgccgtttgcaatcgcagtcagcaccttgctgtaaaaatcataagaaaatgttgtgccctcatcaaaagctgtcacagacttccggcaggcaataccaagctctgtcgtcgtgtacagtgtctctttcacaccggatgcatcaaacacatactccacgccgttgtaagtaaactggttctgtccggctgcctccgcagcgtcatgctcctcagactttaatgccagcggattcatctgctgctctgccgcgtagatgtgatatgtgtcgtcatcaattttgccaagtgccagtgtctgtccatctctggtctcgaacaccagggcatttttcgtcacggccaggatcatcttggaatacacatcgctcggaagctccacaccgtccgctgcaaacacctgaaactcatcaatttttgccgcgccggcataatccttcttcatctcttccgtgcggtaaaagacctcactctgggaatacggattgactgcacctccgacaaaggcaaacaggaacatacagataatgataaccagtcctacaattgccagtctgttgcggaaaaaccgctttgcaaccatcattccgggggaaagtacgcggacacgctgcgcgtcatcaagcttcatattattcttctcgttctccatgttctctcctcctttctagttcacgcggacacgcgggtccacaactgcgtataaaatatcggcaatcaggttgccaagtaagatcaacactgcggaaaacagcatgtagaacataacaaacggaatgtcaccctgtaataccgcctggtaagaagtatatccgatacctgggatctggaacagcgtctctgttaccatggcaccactgaagagtcccggcagtgtaccgccgagcagcgtgataatcgggattaagatattgcggaatgcgtggtaatgaatgacacgcttctccggcagtcccttcgcgcgcgccgtacggatgtaatccgcattcagcacttcaagcatattggttctggtgtaacgcatcagggaaccgatgctcacgatcgtcagtgtaattaccggaagtaccagatgccatgccatatccagaatctgccgtccggaggaaaggctctggaagttacgtccgacaataccgtagaggtcgaaccagccaagctttacggaaaagacccattttaaaagtgttgcaacgaaaaagctcggaagagaaataccgaccagtgcaataacggtgattgtataatcggttgcagaatactgctttctcgcagcggcaatacctgccggaattgcgatgatgatctccagaacaaaagatgccagtgacagtgcaaacgaataccagataacgcttgcgaatttggtcagtaccggctggttaaaataccaggaatcaccgaactgtccgcggattgcttttgctgcccagcggaaatatccctggatcacaccggtgtccagaccgtacgatgcatttaactgtgccacccattcgtcataactctttgctcccggtctctgtgacaatgtcagtgcctgctgctccacgaatgacgacggcatgcaacgcatgatcgcgtagatgatcatggagacgaagaacagtatgacaatcgagagcaatactctcttaacaacaaatttcttcatgattctttttcctttcctcgctgcttctgatgctaaaggtattttgcaaaaaggcgtcacgcatcctcttgcaaaatacctttaaatccctatgcaccatggcacaggttgtagaagaggggagcctgctcccctctccctccaccatcagccagttactctgatccttagttcatctggatcttctcaatctcgttgagatagctatagaaggttgtcagatcctgcggaatggaatccacattgacacgctgtgtactgaatacagaagcgttctgtctctgatataccggaatctctacagcgtaatctacgataaagtcaagtgcttccttataaactgccttacggaatgcctggtcggtattggttcttccctccattaccagttcatccagctcgtcagagtagattgcatagtagtttgcgctaccgccttcgctgtgatagatctggaacatatccggatctaaggttgcctgccatgctgcacaccacatctctgcagtctcactgtttaacgcatcccacatgatggttccgtcagccagatcgttgattgtcagatcaaagccgatggtcttaagtgcctcggatgctgcggtcagaataccgaaggaaggatgatctccctttccgcctccgccgatcattacctcatagcttaacttcgcaccagccggagctgctgtcagcttgccatctgttactgtgtaacctgctgcctcgaagaatccaagtgctgcgtcaagtgctgcagcatacttctcgtcatccgacataccgtctgtgtagatcgggttgccgtctacgtccttggagaatgcaacctcgtagtctgcgtcagacttctgcggtgctgcccaggaagtattggagatcgggtagttaattactgctgctgcctctccataataggagtcgataaccatatcacgatatacagaaattactgttgcgattgcttttcttaaatctttggactgctcagaagaaggatcatcgccaaccttgacattctgagagttgattccgatgtaaccataaccattgttgtcatacagagcggtggttaatacatcaccggacacctcaccgttgctgttctcagagcagatctgtgccataacctctttggagatggacggatcagaaatatctaccgtaccctgaacaacacccggaagcttatctgcctcagcggtctccttgaactggagttccttggtagccggtgctcccttgtagtatgactcattcgcctcgagatatactgtcttgttctcgtagctcttgaagacatacggaccagcgccaagcggagcggtcgtcttctcgcggattgcggaaagatcaccctttgtgaaaccgaactggttgttatcgtaatcgtactggctctcatcaccataataatgaagcggtgtgatctggatatccatggtctgaagtgccggtgcgctgacctctgtcagaacaacacgtacggtcttgtcatccagcttctggataccggaaatatttgctgctgcatcaccggtctcaacaccttcggtagcgtatgcatatacgtcttccggaatcagatcggagagagcgcttcctgcagactcagcctccatagcggtgaagctccatccgtacttgtcaccgattgccataaagaaatccttagcggtcgcatctgccgcaagaccgtcgaagccccactgtgctgctgcgcctgctacgtcgccctcttcgctgacgccgttctctacgcagtaatcaacgatttcctgtgcaaatgctgcaccaccatcgtttacagcatcccagaatgcgttctgctgatcttctgtccagtatgtgaagtctgtgttatcctcgcccgctgccgcaagtaaagatgccaatgtggacataccgcttctgtactcttccataccctcgatcgggagagagtatacagatgcgcctccgtcataagtcggatcgcagaatacatagaaagagaagatgatatcatctgcggttaccggctctccatcggagaaggtcagatcatcacgaagcttgaaatcatagtatacggttccgtcttcgttctctgtgatagtcagatcggttggtccgtagtaagtataatcggtaccgttgtacgaagtggtctcaccctcgataccattgtagataaactcaccggaacgatcgttgtaaaccagagaaatctgtgtcacatcaacgatgttctgatccggcacactctcagcgaagaatgggctgaacttctcgctcataccgtcatttgcgataacgagcggtgtgtcgctgccggatgcagccgtgcctgctgcctctgtgcctgctgtctcggttccagctgtctcgccgccagccttgcttccgccgcagcctgcaaatgaaccgacagtcagtgctcctgccagtaacaaagcaagagtctgtctcatttttttcataatatttcctccttataaaaatattatctatgttttaaccttataaaaggaaaaaacctactccattgtggcattctcaatcagaatgccgctgtaattgcggtcataatactttccgaagaaaaatgcaaccgccagaaacaggaaatgacatatcagatagatacattccattcccatacggatcccaccacggtgcagcaccatgtatacaaggtccagaaccgctccgattcccgtcagcaccattgccccgatacaggaacgcttcatgcgaagcagccccgtctcatagtgtgcccggtgcatacggaccggtgccccgatatagctgaccgcaccataaagcatgtatccaagcggaagaatcacaaacagatacgggaatacaatccacgctgtgcgggacgaatccggatttaaaagtcccattccaagctcaatcacccacagcgcgatcgtccagatgacattaaaaatgcctgtccgccgcttctgctgttcatcaaacggaagcacataaaaatctccctgataggacgttcttgtcaccagaagaccgtgccggttctgctttaattcattttgataatccttttggtaagggttcttgatcatcgccgcttccgcctcatcgctctgcctgccatactgcatagtgcaatattaccgcgttattgcgctaaaatatttttgtgtaacaaaaaaaagtgacaatgaacctctttgtccactgaacactttgcaaaatacacttgtatgttgcacacgcacaacactttttttattatacatgggaaactgtttttgtcaatacttttcccgctggcacattctgcctcgtttcgcatgtttttacaatctcatttggttctatgcatatttttacactatgttttatttgttttttctactttttcttctattctgtgctgtttttctgtcatttttcattttttgatcccaattttttcatgactaaatatgcagttttctttttccatgtttttccacgcaaaaaatcccggaacggattttactctccgttccgggatttctctttcctgtataagtatgcatcacctgcagtcatacataccggtcagttcttatgatgttatgctgtctttgttgcgtacatgaagtacttcataccgaatatcgttgcgtagataccggttacgttagacttctgcatgtaaatatcattgtagtagtagatcggaactactgcccatgtatccatcagcatatcctctgcctgatgcattaagtcaacacgcgctgcaaaatctgttgtggtgcggatctgattgatcagctcatcatatgctgtccagtccggagaagaagataccggagtaccctttcctaactgcatatcgttgttaccggaatcagaggtaaagatctctaacatgttaaccgggtcgttgtaatctgcaagccatccctcacgcgcgatggtgaagttaccgctcttacgatcctcaaggaatacattccagtcctcagacttgatctcaaggttgataccaagtaatgcaacatcctgctgtacggactcagcaaccgcaatgtgtgctgtaccgtcgtttgttaagtatgtcatggagattgccggatctactgcgtatgtaccgtcaccgttgtctgtaaatgtatatccagcctcttccagtaagccctttgctgtctcaagctcgccggcaccggtagctgttgcatcatagtaagaagtatctgctgtcttgaatacgccgccgttaccgtctgccataccttccggtacgaaagaatcagccgggatctgacctgtctggcctacgttctcaacgatgaactgacggtcaaccagtaagctgattgcctcacgcatcttagcagcctcttcctctgtcttgccatcgaagaccgggtcgtttacgttgaagccgatgtaataggttcccaggttgtcaaggataccaaactctggattgacgccgtttaaggaaggaatctcatcgttcggtacggtatcgatgtagtcaaggtcaccgctgttgtatgcagcatagattgctgtatcatcagcgcttaacatgaagtgaagctcgtccatggttacgtttgccgcatcatagaagttcgggttctttacataaaccatgctctcgttgtggttccaggactccagtgtgtaagcaccgttgcatacaaaaccagcttcctgtgcccacttgccaggaacagtgccgtccgtatcagcagcctctacggatgcctgatgtactggatagaatgtcgggaatgccagtaagtcgttaaagtacgggcacgggctgacaagcttgatcacgagtgtgtaatcatccggtgtctcaactgccagtgtaccgtcatcgttgcggtcgattacatcgaacagataagcatagtctgctgctgtcttctcatcgatgacacgattccagctgtatacgaagtcagatgcctttaagtcatctccgttgctccacttggactcaatcatgtgaacagtgtactctgttccgtcctcagatacttccggcatatcggttgcgagtgccgggataagattaccatccttatcataggtataaagacctgcgaaagagtttactgcaaggcagccgccgtctacggagctgtttaatgcaggatcaaggtaatccggctcacttgccaggttgatgttgagcacatttgtctcagcgtttgtggttgttgcttctgcagttgctgcagcctctgtgccagcagcagttcctgtggactcgcctgtacttgctgtggaatcagatgatccgccacaagccgtaagaccaagtgccatagaagcaaccagtaatgatgctactaatttcttcataatgaatcctccttgttttccgaaggaaaatgcgactgtcacaacaggagcagaggattttcctcctataaaatgatctatgttccacgtaccttttcggtaacgttgaaaccttacttattccagcatgcaacgaagtgtccgctgcctctgtcggaaagcggcggcatctcttttgcgcactgctctgtcgcgtatttgcatctggtgcggaacggacatccggtcggcatcttcagagggctcggtacatctccctccagcacgatacgcttgctgtgtctggctgtctccggatccggaatcggaaccgctgacagtaagctcaatgtatacggatgcatcgggttgccgtttaactcatcggcatcggcgatctccatcatttttccaaggtacataaccgcaatacggtcggaaatgtggtgaacgaccagcagatcatgcgcgataaacagatacgccacgcccagcttgtcctgcagttcctcgaacatatttaccacctgcgcctgaatggacacatccagtgcggataccggctcgtcacagacgataaacttcgggtttaccgcgagtgctcttgcaataccgatacgctgtctctgtccgccggaaaactcatgtgcataacgcatggcatgctcggcattcagtccaaccagctccatgaggttcaagattttctcacggcgctcttttttattcgcatataatttatgaacatccagaggctctccgatgatgtcctcgaccgtcatacgcgggttcaaggatgaatacggatcctggaataccatctgcatctgtctgcggtaaggaagcatgtccacatccactttcttgccaagcaccggcttgccgtttgcatcgacgatcagcttgccattctcatcatactgttcgccgctgtcaaaaagcaccttaccatcgaacacgatgcgtccggcggtcggctggtacagacgaagcagcgttctgccgacggtcgtcttgccgcatcccgactctcctaccagaccaagtgtctcgcccggcttgattgcaaatgaaatatcatccaccgcttttagcggaatcgtcttaaatccctgatgcacaggaaaatactgttttaaatgacttacctcaagaaggttcttttcctcactcattactctgcctcctcctgtgcctcatataactctttgatgttcatccagcagcttgccagatgggtatcgctgatgcgaagttcttccggtttctcagaaagacagatcttcatcgccgcatcacaccgcgggcagaatgcacagccagccggcatctgcaacaggttgatcggtgtaccgccgatcggcaccagcttttcgttcatattgtctgccttcgggatggaacgaagcagtcccttggtatattcatgtgccggacggtagaaaatatcatccgctgtaccgcgctcgcagacacgtccgccgtacataacaagaatctcatcacacatacttgcaatgacgccgagatcatgggttaccatgataatcgccattccaagcttcttctgcagatcctgcatcagttccagaatctgtgcctgaatcgtcacatcaagtgccgttgtcggctcatctgcaatcaggatatccggctcacagacaagtgccatggcgatcatgacacgctgacgcataccaccggacagctcatgcggatactgcttcatacggctttccggctcattgacgccgaccagtgtcagcatctccaccgcgcgcgcccacgcctcttttttattcttatccgtgtgtaataatattgcctcaatcagctggcttccaacggtaaataccgggtttaagctggtcatcggatcctggaaaatgatggagcatttttctccgcggaacttctgcatctgcttgctgttccatttggtaatgtcctcaccgtggaatcttacctctccgccagtgatcttaccggtctccgccagaatctgcatgatggaatatgcggtaacggatttaccggaaccggactctcctacgattccgagggtctttcccggctctaagttaaaggaaataccattgacagcctttacctcacctgcatctgtaaagaaactggtatgaaggtcttttacttctaatatatatttattttcttcgctcatatccttatctccttaattcaatttcgagtcgaaagcatcacgaagaccatcacccagtaagttcaatgccagcacgatcaggcagatggcgattgcaggaatgaccaatctaagtgggtaggactgcatgccggctctggcatcgtttgccagacttcccagggaagtaagcggtgcagatacaccaaggccaaggaaactcagataactttcggtaaaaattgcactcggcacctgaagcgctgtcgtaataatgataacggacagacagttcggcaggatatgtctgcgcaggattctggcattctttgtaccgatgcatcttgctgccagaacgtactcgttgttcttaatggaaaggatctggcctcggatcagacgcgccatacttacccagtacagaagtccgaatacgataaacatggagatcatgttcgttcccagcttttccagcaccgttccggtaatgagcggttttaacgtctcattaaacactaccgacagcagaatgatgatcagcatgtccggcagggaataaataatatccacaatacgcatcatgatgaggtcgacttttccaccaaagtatcctgcgatggaaccgtaaagcaggccgatgatcaataccatgatcgatgccacaacgccgaccgacaggctgactctcgttccgtagatcacacggataaagtagtcacggcttaagctgtccgttccgaagatatgtggaaacagcttctcgccggtctcgttcatatactttgtctcaagcttggaatattcaaacggtccaaggttcgctgcggatttgtcacgcacaccgttgaccgagataatctcggaatacttgtaaggacatatatgcggtgcgatgatgatggtcagaagaatcaataccagtacgatgatacttcccatggcaagcggattcttgcgcaggcgtctcataccatccttgaaaaatgtggtagactcacccatgacatcctgctgctttttttcctcatctgtcgccttctcgaaatttgccttattgaatttgctcagatctacctgtgccgacagaatctgtctatgtttcaactccattacttctatccgtcctttcgtactttactcaaatgtgattcttggatcgacgaacttatatgcaatatcggtcagcaggtttgccacaaccatcagaattgcgaggaaaattgtcgttgccataatcatcgtatagtcacggttggtaatacttgttacgaaagacgatcccagtcctccgatagtaaaaatattctcaacaaccatggaacctgtcaaaatgtatgcaaccatcggtcccacgtaagtgattaccggaatcagcgcattgcgcagtgcatgtttgaaaatgactttccagcccggaacacccttcgctctcgcggtacggatgtaatcctggttcagggaatccagcatactggtctttgtcagacgtgtgatatacgccatcggataaacactcagcgcgatgatcggcagtacataattcggactcgtggacgaccataccgggaaccagccgagttttaagcagaacaccagaagaagcagtgttgcaagcacgaaggacggcatcgccgtaccaagtgttgtaaaaaatacgatcagccggtccggccagtgattacgcgtcaacgccgcaatgcttccaagtacaagcccagccacgattgccaccaatgcagccatgccgccaagctttgccgataccttaaaacgggaagaaatctcgccccagatatcacggccgctatgtaaagatacgccccagtcaccatgaagaagattgttcatataaatcacatactgctccgggattggtttgtccagattatatctctcttccaggactttctgtgcctccgcactcgttgccttttccttattgaaaggaccgcccgggataatgttcatcacaaagaatgtaatggcactgacgatcaggatggatacaatcgccagtaaaactcgttttacgatatactttcccactttttttctctcctgcttcttgaaaattctttctcattttatcgctctagcattgcgttcttttatctgtttgtatctctaatgcaatgtcacgttaacccgataaaataatataaatgtattatactcgctcactatcatttgtcaactgctaattgtatacaaaaatacatggatattacctcctttttctgtacgcccagtaaatacaagtgtttttcccacataaatactctgtctttttttttagaaatttgttatactttcttcaatcacactatctcttacagaaagaaggcagatccatcatgattcaaaatgatgatattctgaatatgaacttttataaaaaggaaaaatttaccggcagttatcagggaatgcgttacctcatccaaaaagatcaggaggaggatgccgaggacgaaaatgtaaaacatgatatttttcgcgtcaccatctggcccggtccttataattttgccagcaccgcggacgatctgaaaagttctgctgtctttccgtttacgccggagggcaaagagcaggtggtcgactggctgaacgaacagtggagtgcgcgccgcaccgaatggcccggccgttgaatcagtctctttctttatatgagcatctcgctgattcattatcactgcactgtaacacagcaccaaaaaaagccacatacgaagtatacatcttcgtacatggcttttcttattctattcctattcacggaaacgcccgtaaaacccgaaaacttcacgccgtattctgcgctctgtctcctgctctactgcgggtaacaggagcttgaaaaggttcaagtcctgtcttccacttttctcctgctctactgcgggtaacaggacttgaacctgcacggtctcccaccagaacctaaatctggcgcgtctgccaattccgccatacccgcttatcagagaaataactgcttcccttggaaagctaccggtatattatagcgtgctggcagacagattgcaacttctttttggatttaagcctccggcttctcatagcgtgtccacactttgtccgcgccgcatacattcttcgtgccgtcctgctgaacgataatataatcgccctcaccgataaaggtacgtcctctgcggtgcttgatgtacgggcacacgatcgtaccgtcgggccgctcaatctttacgagcgaatccgtcacgatccatcccttggtcacaacatcggaaaacagttcaaaaccatcttccatcccttttcccacttcgtatttgtctacttcggactctaacggaattcttcgactcttcataggtctcctccttttccggtgatgctccctgcttaccttccttatattctgaacactttcgtccgccgcatgaaaacgcgggcgtccgtcctggcaccatattcacttctgccttcgcctatattataccatactgtccgaaaatttacatgccttttttcgtactttcgcactattcccatgaaacaacaaaaatccccgtgatgccggaatatgacatcgtgaggattttcgctctatatgcctgccgtattccggcagcatttcttatttcttatttcttatctctttatgatctggcgatccgctccgcctgcgcccttcgcacaaaccggaatgcgccaatgctctcaagcgccttcgctgttgcaaagaagatgacggaatcaatcggccacataatcagattctttaatgcacgcgccggaaggatcaccatgaatgcctgtccatataacacggtgaggcacaatgtattcaggaacacattgcacaccagcatcacgataaacttggtggcaagcaccctcggcagtgtgagtttcttcttataatacatacagccgtacatgacgcctgccagcatcgtaaccagtgtcagctgcggacagaacggaccggtcggctttaagatgtatttaataatatcaagcgttccggaaaaaatgccgccaaccgtcggtccaaacaggtaggcaatgattccgttcgggatactcgaaaaaccgatgcggataaaattgccatattcgatggagaacatgccaagaataatggcgatggctgccagcatagccatggtagtgatggttcttaccgattttaattcacggtaggaatcggtgaacaaagcgacgaattttttcataaaaaaattacctcctttgcagacctcatcatactacaactggagataatattcctatcttcggatgcagcgggatgcgactcatgcaccgcaagaaactcttttcgtctggctgacaactccctgttcagccggcacttaacgcgcatgtgtctactctgcgaacaatatttacttgcaacggtaacagtataacataccttagcggtaatacaataggcaattctcactaagttttgttccaaagtcacaaaaagcggaaaacctttaccggctttccgctctccattccttagtgagacacgggggattcgaacccccgacaacctgattaaaagtcaggtgctctaccaactgagctagtatcccctatatcagattacaacaaaagcaagctgggctagcaggattcgaacctgcgaatgctggaatcaaaatccagtgccttaccgcttggcgatagcccaacaaataatcgttgcacctatcgcaactaaggtggatacagggattcgaaccctgggcctccagagccacaatctggcgcgctaaccaactgcgctatacccaccataaaatgtgctcgaagggattcgaacccccgacccacggcttagaaggccgttgctctatccagctgagctacgaacacatatgatcttgtataaacctgtcagtgcagatttaaagcgggtgatgggaatcgaacccacgtatccagcttggaaggctggtgttctaccattgaactacacccgcacgaaatcggggtgacaggattcgaacctgcgacctcctggtcccaaaccaggcgctctagccaagctgagccacaccccgaaggattttatcgcttgcgcactcttccggccactgagctgtccttttcgtgacgcaaggattattatataggacagcttctgaaaagtcaacacttttttataaatattttatttcaaaatttgcctttccgtttttgtccagatccatcacaatgtaggacggtcttctcccctcctgcctcggataggaaagactgcccggattgagcgcaatcacatcccttgtgtaatcgatcacaggcctgtgcgtgtgtccgaacatcacaatatcatagccctgtgccgccgcttcccgctcaatatcggcgatccccgcactgacatagtaataatgtccatgcgtgatcaatacacggtagctgccgatgcgaagttctttttcccgtggaagattggaaaaaaagtcattgttgcccgcaacgatctccagccggcagcccgccatctccgcaatactgtcctcatctccctccgcgtcacccagatggatcagaagatccatcggctgctcacgctctaagataacttttaaattttcaagtttcctgtgcgtatcgcttacaaccagtattttcataggctaaaacccgtactcatgcagcagcttcttcatggaacgaagtgcttttcctctgtggctgatctcattcttctgctcttctgtcagctccgccgtcgagcagtgatactcatccacatagaagatcggatcatatccaaatccattctcccctgccggacattccccgatatatccctcgatcgtctcccgtgtcacaagtgtcttcccgtccggaagcactgctgcaatcgcacagacaaaccgcgccgtgcgctgctccttcggcacgcccttcaaacggtcgagaatcgcctgattcttaatatcataggaggtatcctcgcccagataccgcgccgaatatacgcccggctccttgtttaaataatctacctccagaccggaatcgtcagccagcacaatatccttcgtacaggcagctactgccttcgccttgatctgcgcattctcctcgaacgtcgtgccgttctcctcaatatccagggaaatacctgcttccttcatggagcagatctccatatccatatccgccataatctcgcggatttctctcatttttccggcattgccggtggcaaaaattattctcatggctttgtcctctttttagtatccttcttcaaatgcgcgaagcactgcctgatagacgccctctgccgtctccatctgatatgcatcagaattcagcttttccaattcatctttgttcgtcataaatccgacttcaatcagtgcaaccggcacctcactggttctaatgatataaatactgtcgccttccaccagtcccttgtcacggcttccaatcctgcctgtgacttcctccagacagatctgcgcgaactggcggctcgcctccgacgtctcgtcgtacatcacctgcgtaccgctggtacctgacatgcgtccgcttctcgtcgagttattatgtatactgatgaaaagatccgcgtcagacttgttggcaagctgcactctctggtcaaacgtcggattgctgtcatccgtcctggtgtaatacacaccgatgttctcatcgctgttgtcaaaaatctccttcagcttcagcacgatcgccaggtcaatgtccttctcgttgattccctgcttgttcgcaccgacggctcttcctccgtgccccgcatcgattacgactactttatcatagacttcatgaggtgtcaaaaaattaaaataaaaagtctgagtgtcatattccgtctgcagttcatataccttgttggtcgtgacctctatcacgcccgtctccccctgcctggtgtaggagaggccgtcaatatagtcgctgttccccagaaccgggtagctgtcaaaatacgtgcggtccgcctgcggaatttccacccggatggtctgggtcacataatcgctgctgacagcaatctgatccccggtcacaccctccggcaggcgaatactcaattctccctttgcccccgccgcttcattctgctctttgatctttaagttctgcatcgtgacctgactctgggcgaactcttcctcagcaatgcgttcctctctcgcctccgcctcccacgtgtgaagcgccggaagctttggcagaagcacaaaagatacagctgtcagaatcatgagaaagacagccgacagtctcaatgctttttcttccataaccgtatattcctttatcgattcttactgaatgccttaatacagagattacattcctccaccgtatccacgctgtcccatctggcgccgttggtactgatataactctcgccatcgtccagaatcacatccgcagtcgcctcgtcggcagcgtattcgattgccatcggatgcaccgaccccggcgtaatcatgtgaagcacaatcgcataacgctcccccgcatccagtgaaattgcctgattaaaatcaaccgtataatagcccgcgttggagagtttgccggacgccaccggaatccgctgcgtcagcgaaccggcatcctcaaagttccttacaacgtacagctcgtactgggagtcttttcctatcgcgtaaaaaccggctgccaccagttcctcttcctgtgacgtcgtgtagacattggcgccgtaggcgctgtccttgttatagccaagctgtccgacccagccgcacagatcgctctgatagatatggtcatagttgcccggctcttcgatctttgtatacacaacgttgtgggtgcctatattcgtatcataatacgatatgtaaaacaccccgtcctcgccgaacgtatctccccagctgttctggcagataaatgcgccgtctccctcgagatccacattaaaattctccttggaataactgtcgtcccagccgataatcacaacgtcgtgattcggcttctctgtaccgatgtagcagtaggaatttgtcttctgattgtaatacggagactttgactgcgagctgcgcagcccgttatagatcgacgtctgcactccgccgtataaaaagaccgactccttgatcttctcataatcttttccgtcgatgatctgcatttcctgcacatgcttgaccgctgtaagatccggattcgttttattgtccccgtaagggtcatccgcttcgtatacaggtccttcccatgccgccagataagccattcccatggtatattccccgccgtcatcctgcgtcagtgtaaatccattgttcatcgtcatatggtcgaccgaaaactgcagtttctcttccggcagcaacgacgactccagtgcccccagcgcggcaaacgcccagcaggtgccgaaagttccctgattgcgcactgctgccgcccgtcccttctccctcagatcatagcgggtcggtatgattgtcgcactgtccgacgtgtccatcgccgacgcctgattctcctgtatatcccaggaataggaataatccagataattcgccagatcattcaggcttacatagtaggtatcgtccttgcggataaacggcgacacgatcacctcacgggttccgttgactttcgcctccgaggcgcccagtgaaaactccacctcattcgcatgcttctccacaaggagccgctttccgtcatacacatgcgcgctgcagttgagtgcatcgcgcagaatgttcaccggaaccatgatattcagctggtcatccatataaaacgtatggttctcgttggtgtattccttgttatcgatcaccagcgacaacagattatcatttacgctggatgcgatcaacgggttccaggttgccgcctgcagattggctccgcggaaattttccaccgttccgctccccgatgcccccggttctaatttaaaaatcagcatggcggctaccagcacgccaaacacgatatatctttttgaatatttcattcatcccctccggcggtatcccttacgctccgccttggtggcttcggccccataaactggtaaaaataggtgcgaagcattccattgtagatcttgcggttcttgtccgcttttctgccgatatagcgctccgcttcatcataactcgtaatcagatacatcgaccaggaatcgagtccccggaatgccgccccgatctccccgtacagcttcggcagatccgccttgtcctcgaggcgctcgccgtacggcggattcgtcacgataaagccgtatttcttcgggtggtggagttccgctaccgggcgctgctgaaaatgaatcaggtgatccacgccggcgcgttttgcattctccctggctgcctttatgacgtccccgtcaatatcatagccctgtatgtcgaccttcacatccgtgtggatcatctcctcggcttcctttacgcactcgtaccacagcttgcggtcaatcaggttcgtccattgctccgccgtgaactcacggttcattccgggcgcaataccggcagcaatcatcgccgcctctatcgggaacgtaccgctgccgcagaacggatccaccagaatccggtccggtctccacggcgtcaacagcagcagggaagctgccagcgtctcggtcagaggcgccttgctcgtcaatgtgcggtatccgcgcttgtgcagggagtccccggacgtatccagcgtcaccataacctcatccttcagcagaaagatgcgcaccggatacggcgccccgtcctccgcgaaccattccacatcatagtgctgcttcatgcgctccaccatcgccttcttcgcgatcgactgaatatcagacggagaaaacagcttgctcttgatagaagacgccttttttacccagaactttccgttcacagggatatagtcctcccacggaagcgccttgattccctgaaataattcctcaaaggtcgttgcgcggaatctgcccacttcgatcagcacgcgttctgccgtgcgcagaaagatattggcacggcagacagcttccgcatccccctgaaatgagactctgccatcctccacccggctgatctcatatcccaggtcatagatttctctcttaagtaccgcttccagtccaaaatgacatggaaccaccagttcatatgtcttcatgtattctcctctgtatcatatgtctaatttcctaataatatattatccattctaattttccctgtcaatcacttgttcgcattgcctcaatgccgccaaccacggtatatacctcatacccctccctgccgagctttctcgccgccagaagactggtgcttccataatcgcagtagagcaccagcggtctgttcttcggcagacggtgcatccactgatcgatcttttcatacggaagatttctggcgttcggataatggtattcccgataagaatccgcctcccgcacatcaatcagaattccgtgctttcttctcataatatcttccaattcccttggatgtatcgtataaaacgtcatgcccgcgtatcctccttttccgccatatgctcctgtaatcgcaaaaacagattacaaagaggttctctgtaatctgtttctgtcaatcttattctatcctatgcgctttttctctgcctgtgccagtctactgctgatacttgtcagaggtcttgttggaaccggacacgttggatgtcttgttggttgacttgttggtcgacttattctttgcgctgttggaaccgcttcccgcgttgttctcgtagctgttctcataaccgtctctgcaattagaagtcgaattctgtgtactttcgttttttgccatgttgccctccatcccggcacgtgctcgtgccgaatctttttatttgcttactgcatggttagtatctgatgttccccggaaaatatacatggcttttgtggttttgcattgctttttcaaaaagaatgttctatactaatgctgtgatatgtaaaacatatcattttataccccttattaattatttatactcccctcagaaaaagccaagtgcatcgcacctggctttttctatcttatcacagttcatatcttatcacagttcataatattcgagattgtcggtaagctcctgcgtgatcctgcctccggctttctgatacttgtcatagactccctggatacgctgcacggtcttcgcgttcaaaagatcgaggcggtgcagagcgctctcatacatcggattcccctttaactcctcccggatcggctttgcgaacgggcaataggtaatcaggatctctcttgcgatcttgttgaggcggtagcttcccttcgactcatacttcatccagttctggtaatccttgacgaagacctcacggtaattatttcttccacgcaagagcgcactcttgatcttctccttcgcctcggcggaaagttcgcggttcttccggtagaactgcagataatcgcaatactccgccgtcagggacttctcacggatatcgttccagtgtacaccctgaatcttcctgcagatctcccagcggtatcttccgaccgtatcgaccatcatatcgtcaatatcgaccgctgtaaaaatcgggaacaggaaacgcgccgaggtatctcttcgcacgcctgctgtctcctgccacatcatcgagcgtgttcctgcattcggcatcagaatgatgtccggcatgatctccttcataatcatctcgcggttgatgcccttgtccggatccgagaactgcacttcacgatagaacgcggagaaatcgatgtcgcggatcttgtgcagtgactcgtccagcttctgcgccgtcacgagcatcttttcaatggagttgatcagatcatactcccctaaaatcgggcagaacgtggacagcttgccataggtcgcacggtttccggacgtgaacatgttctgaatctcaaacttgactttgagctcccggttggacataaaatgcttctgctgctctgtcgtaatcttgccggtcttgcgcatctctgcaagatatgccggataatccatatcgaactcatttttcgacggctcgtttcttccgtcataaacactgcgcagccattcaaaaatcgtgtatacatggtcagatttgcagacatccagatgctccgtgagatcgaacagaatattggcattctcctcgccggccatctgcacatccataaatccgaaattcaaaaacatttccacaatcggggtaagctctttttccccctttacggtatgcataaacgcttttaagtaggtatcgtagaaaatctgtgtgatccgcttgcggattgcaaacgtctgcgcgtccgtggaaaacatatccggcagatcccggtacttctgcacaagctcctgcatctcctcaatgacgctctgctcggtatccgcataggtcaggatatgaaccaggcagtcttcactgcgctcttcctgcggttcttcctcctcgccatcctgtgcctgcggcgtctcatacgctgcaccttctgtctcgaaatggtatccacggtattcttccatccgcatgtcgaccagctttccgctgtagatgccaagctttttgattacctcggcaatccggtccatctcatttaaaagcggctttacatcataatttttcttctgcgcctgaatcgccagagcaaagaacaggttaaaaagatcgtttttcgattccgccagaagaatatcctgattgtagcggagatattccaccatctcaatgattccctgcgtcacacgcctggtctgataactggcttccatgatcgccccgatgcagagattatcgtcccgctgcatcagatgcacatactcctctaaataacttccggtcaggctggcactgttgcctatctcccagttctccgcccggtgcaccatctccaacggcttgaaattgtccatgcgcgtaaaactctgctcgtccagatggtactgtgcgcagagattctcatactggctgtactcattctcggcaaaggagtgaaactgccttaccagattggtaaaaccggcataggttctaagaagcatctgccgctgtccgagtgctgcccgaagcagaatactgcgcatgctctcctgcccgtgaatcgcctcctttaaatcctccgccgattcacaattgaacaccgccagcacggaatcctcggtcgcaacataatcacacagatatctgtcgccctcagaaattccaatcaccgcattttttccaagaacaatcttggcgtaggaattgcactgaatgacagtaccctcctgcacgatataccatttttttactttctctttctgcttggcaattatctggttcttctgtacctttactgtcgtcatcgtctctctgtcccctgcctgcgcacatgaccgtgtgtctactgccccttcgcgcgtcctttacttattattaacaattccgtaagcagctcgtccgctgcctcctctttactcatccgtgccagttcccgctcgccgtcctctgtgatcagtgtcagcacgttcgtatcggttccgaaaccggcgccttccaccttcagattattggctgcgatcagatccacattctttttgcgaagcttttttcttgaattctcaagcatgtgctccgtctccatggaaaacccgcacagtatcgtctttcctttgtccgcccctagagctgccagtatatcctgtgtgcgttccagttcgatcgaagcttcccgatcggacttcttgatcttctcctccgccacagatgccggtctgtaatccgccaccgctgccgccttgacaataatatcctgctcctttgcacggctcatgaccgcgtcatacatctgtgccgccgtcacaaccggaacaacattcacaaaccgcggcggctcgcacgctgtcggtccggtcacaagtgtcacatccgcccctcggtacatggcgcgtctcgcaatcgcatatcccatcttccctgtggagtgattggtaatatagcgcaccgggtcaatcgcttcctgtgtcggacctgcagtgacaagaatttttaatcctgccatgtcctttggcgcagcaagttctcttaagacatactcggccagctcttcctcggacggcagtttgccgtctcccgtatcgccgttcgccagcatcccccgcaccggttcaatcatctcatagccgtaatgctccagcttgcggatattgtcctgcacaatcggattgtggtacatattatggttcattgccggggcgatcaggcacttgcaggtacacgccatcaccgtcgttgtgagcatgtcgtctgcaattccgttcgcaatcttgccgatcacgtttgctgtagccggtgcaatcagcaccagatccgcctgtttcgcaagcgccacatgctccaccgagaactcaaaattccggtcgaacgtgtcaatcagacacttgttcgccgtcagcgtctcaaacgtcgtcgctgtgataaaattcgtggcattctgcgtcatcagaacatgtacgttgcacccaagcttcttcaacatgcgcgctacattcggcatcttataagcggcaattcctcccgtcacacaaaggagtacggttttcccgctcaaaagtccccttggcttttcgctctgcttattcattttttcctcctgctctcgttcacttatcccatgatacgatgctaaaattccatttttattctatactcttttccctctctgtgcaatgcctttctgcctgcgcgcccaactttcaccgctaaatgtaacgcggcatttcctgaaaaaagaatcctattacataaaaaacgcacagaccgtgtcacgtgacacaacctgtgcgcaaataaatatgttccctatacaaccgcccggatgtaatgctttacctcgcgcagctttttcacaaactggttgtccagctcatagaatccaaggccaagcggaaccgtaaccagaatgttaaacgggacagcaatataccatgccgtctgcatgatcgcgccgcccagttcaaagtgatagtataccatctgaatcaggaagatatgataggaagcttttccaatctgtgtgagcagtctccccgcaaatcccggaatcgtacagtgataaaatttccggaacaataaaataacgatcgggaaaatatagaacgcaaccggcatcgctgtcgtcttccagtagccaaacaactcgaaatccttgtcgaatccgaaaactgcaatcagatatgccagtcctgccagaaacatcatccacatctgatacggctttaccctctgctccggatgcagatacagataacagccaaacgcgattaagagcaggtatcttccgatgctcaggcggtaataatatttatccatatcaaacacgatgacgcacacctcaaacgcgagattggcgagcgctgccacagcaagtccaagcttagcattgtatgcgatcatcacataaatcaacggaaaaataacaagcagctgcagcatgatcggtacataatagcttccaggtccgtatgcgccaagcacaaaaatacggaacaacggtatatttttatcctgcgctgccagcaacagaatctcaagcagacaaatggcaaaaaacggcagcaaaaagcggatcagctttggtttcatcatattccagccatacattttctccagatttccgtctgcttttttgcggtttgacattgcaaaattataaccgctcacaatcataaataccggcactgccatgttgatcagcatcgtaaaaaaaggagatgtcttatcctcccatccatagtgcgtaatgattaccataatgacacagactgccttgagataatccagaaattcgattctctgtttctttccctcttgcatttctaatcctcattcctctttttatacacaatcctgatgtcctctttttgacaccaattctgtatattacgcactttttgcatgattttcaatagtaattgtggctaaatttgggcttcaatcgagggatttataaagcatttctacgatatgattttcagataaatcaaaagatatatactatagaggaaaaaaagacccggaagatgatcttccgggctttcctacgtgcgcgagaggattcgaacccccgacaccttggtccgtagccaagtgctctatccagctgagctacgcacacatattcttttttacatatctattatagcactcttgtcaagtagctggatatgaatgccggcgaccggaatcgaaccggtactgtgtcaccacaacaggattttaagtcctgcgcgtctgccagttccgccacgccggcattactgtaacagttgttacagaagtgggacctatagggctcgaacctatgaccctctgcttgtaaggcagatgctctcccagctgagctaagatcccatatgaaattatcataagaacaattttgctctcatgagcgacccaagcgggactcgaacccgcgacctccgccgtgacagggcggcgctctaaccaactgagccattaggccagacatcttacaaacgcttttgtgacaagtggaccatcggggactcgaacccaggaccgaccggttatgagccggttgctctaaccaactgagctaatggtccaagtagattacttctataagccgatgatcggactcgaaccgataacctgctgattacaaatcagctgctctgccaattgagccacatcggcatatttacctcagctgattacagccagccaaaagctagtgactccaacgggaatcgaacccgtgttaccgccgtgaaagggcgatgtcttaaccgcttgaccatggagccaggtagttttacaaatacacttctacagtcaaaaaaaactccccgagtaggactcgaacctacgacagcgcggttaacagccgcgtgctctaccgactgagctatcgaggaatattagctgatacacagcttccggtaaaacctatcataaataagttgtaccttcaaaacttcacacagaatccatccatcaaacctgcaaacattattcgttatatttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactctaattcgctccacatcacgtcttcggattgtctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcacttacgtgattccacagcttcggtgttgtgttttagccccggacattttcggcgcaggacctctcgactagtgagctgttacgcactctttgaatgtatggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggataccgccatgtcatctttcctttcgcttacggggctttcaccctctctggcaggctttcccaaaacctttctgctaggattgacgaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgagatatgctcatgtgggtttccccattcagacatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttggtttggtcgtaaactttgtttacgatattctcggatgtcttgataaaaaatcattttcatcaaaatcttctgtatgaagttttcaaggtacaatagcatttcgcgcaatggcgctcatgcattagaaattgctttgcaatttccgtcaagcggaatgttttgcaatttcaatggagatggtgagattcgaactcatgaccccctgcttgcaaggcaggtgctctcccaactgagctacacccccattcatgcagttttctgcatgactaaatgggcttaagtggactcgaaccaccgacctcacgcttatcaggcgtgcgctctaaccggctgagctataagcccatttgaaatctggcagccacctgctttcccataccgtcgccagtatagtatcatcggccgcttaggtcttaaccatcgtgttcgggatgtggacgggtgtttcccctaagcgcatcgccaccagaaatttgtggctatcaatatttgattgttattgataactcaacagtgaacaaactctctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccaaaccgctggctactaagaataggggttgcgctcgttgcgggacttaacccaacatctcacgacacgagctgacgacaaccatgcaccacctgtcaccactgctccgaagagaaagtacattacatactctgtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaatcatctggcttattcagatgttactctgaatttactgttttaggttgttctttataagaacgttcgtctgtctttcaatctcttgatcgacagcttgaaatttaggatctttcaaggtttattcactgttcagttatcaatgtacatcgtcaatacttcgtattgactttagaagttgttctgcaacttctgagtggattttccagcctcactcactgttgtcatctctcggcgacagcttatttactatatcataccgtcaaccgtttgtcaacaacttttttgtttttctttcgcttctttcgaagcggtcgttcgcgtttcgtttccgattcgcaatcagcttgattagtatatctcgtgtcgactgttttgtcaacaacttttttcgactttttttgaattgtttcaacaactcagaaaatatgtctatcaagcgagcggagaaggagggatttgaaccctcgcgccgctattaacgacctgcaccctttccaggggtgtcccttcggccagcttgggtacttctccgaataaaataatgatataaaattgtatcagcacttctgttaccggagtcggtatcgtctgtgttgataagcggagaggatgggattcgaacccatgcgccctttcggacaaacggttttcaagaccgcctcgttatgaccacttcgatacctctccgtgttcttgtctcaaatcagtgcagaaataatattaccatctgcttccaccaatgtcaacactttttttcactttttctatttaagtataattccgctgccataatgtcttcaggcgtcgtgatttttaggttctgataacttccctcaatcacacgaacctgctctccaaatgcagtctccagcatcatcgcatcatctgtgacggcagaatctccctgtgccatcaccttctcatacgccttccggatccgtccgtagggaaatgtctgcggggtctgaacctgccacaggctgctccgctcgggcgtctcttttgcaaagccatccgccccgaccactttgatcgtgtcctttactggcattcccaccacgcaggaatccccctctctgacgcacgctatggaccggctgatgatatcggcggtaacaagcggtctcgccccgtcatggatcagcacgtaatcgctcccgtccgccgccttaagcccttcatacacagaatggtagcgttcccgtccgccttccacgaccgcacagaccttttggatatgatatttttcaacaatctcttttctgcagtaatcgatctctcctgcccccactacgacgacaatgtcggttaccgcgctctctgcaaacgcctgcagcgcataaaaaagcaccgggcggccggcaagcatcatatactgcttgtgcacatcactgtgcatccgttttcccgccccggctgcaagtaccactgctgttattttttccactatcgctcccccagcttcagattcgggaccgcattcagatccagtccgtccctctgaccgcgcatgaaatcataatatgccgccacaccgatcatcgccgcattatcggtgcagaaaatcggcgacggatgataaaatgccacgcccttcttctcgcacgccgcacgcattccctcacgcagggtgccgttggacgcaactccacccgcaatcgcaaatttgtccattccgaattcatcaatcgctttcatggcatttccgatcagcacgtccgtcaccgctttctggaaggacgccgcaatatccgcctgtacgatcggaatgttcttcattttacaaccgtttaaatagttgagcaccgcagacttcaagccgctgaagctgaagtcatacgggccgtccacgattttggcgtgcgggaactctaccgcatgcggattcccctcatgcgccactttttcaatcttcggtccacccggatagccgagtccaatggcacgcgccactttgtcaaaagcctctcccgccgcgtcgtccctcgtttttccaaggatctcgtattttccataatcaagcaccttgacaagatgtgtatgtccgccggacaccaccaggcatagaaaaggcggctccagatctttgttctctatgtaattggcgctgatgtgcccctcgatatgatgcacacccaccagtggcagctttttggcatagctgatggcttttgcctccgccactccgacaagcagtgctccaacaagccccgggccgtaggtgacaccgatcgcatccatatcatccagcgtcatccccgcatccgaaagtgcctgtccaatcacctgattgattttttcaatgtgtttgcgcgaggcaatctccggaacgacgccgccatacaaggtatgcaatgcaatctgggaggatatcacatttgatctgacatcccttccattcacgacaaccgctgctgccgtctcatcgcacgagctttcaatcgccaatatttttatctcattactgttcatcggaagaatctccctccacctgatagaataccagaatcttccagtctccatcgtcatcttttctcaaaacatacatttcgttggtacggtcgaagctgttgttctcattcataaaataagacgccgtcacataagcgcactctctcccgtccaccgtctgatacaccacatcattgctgtcgcagacattgctgctgcgaatcgtttttgatttgttgtggtaatcttcaatatccgctttcaggtcggaaagatactgatcccgcggattgttctccaacagttcgtcgtccagcagctttctcgcctgatccgccagcgactccagttcatcgtccgtataggtatcatcatagaagcactccagaatacggttgtaatacttcacaacctcacgcggagttgccggatagttggcatccagattctttgtgataagcttttgtatctctgtcaactccactgtatcttccaccgatgtccgtctctgtgtcgtaaaaaagtaatacgctcccacgatcagtaaaatgatcagtattgttatcactgccttaatcacgccactcttcttcattatgacaacctcccttttctttagttctcatcctcaaacatcaattccacgcttttcccgtcttttcccaaaaacgcatccgggaaaatctctcgcacctggggcagatagttctctgcatgcaccagggatggagaatagtgggtcagccacatttccctgacgccggctctcttcgccatgtctgccgcctcatagaatgtcatgtgtttgtactgcttcgccttgacaagcttctccggctccgcatacattccctcgcagataaaaaggtccgatccctccgccgccgccacgattgattctgtcggtctggtgtccgtgcagtacgtcatcttgatgccgcgtctggctggtccgagcaccatctccggcgtatagaccgttccgtcttccccggacaggatctctcccttctgcagacggctccagtatttctgcggaattgccgccgcacgcgctctctccacgtcaaacttccctgcacgttttatttcgaccgaataaccgtaacaggtaacattatgattgacacgaaatgcatgtatacagtatccattgagttccagccgcatttccggttccgtaatctcaataaaacgtatttcaaacggaagttccggagcaatcacccggagcgcgttcaccacccgttccagcccccgcggaccgatcatggtcagtggctcggttctgtccgcatttcccatggtgagaagcagtcccggcagtccgccgatgtgatctccgtggtaatgggtaaaacagatgacatcaatgggcttaaacgtcagtcccttttccttgatcgccacctgtgttccctcgccgcaatcaatcagcagactgctgccgttgtaacgcagcatagccgccgtcagaaaacggcggggcagcggcatcattcctcctgttcccaataggcatacatctaacatgaataaactcctttatcgctatatcagttctgtcttttgttccacctccggcgcgatggcaaacgtccgcacccaggcgtcataacacgattcgcacagatccatcctgtgcaccgtaccgtcttttcgttcggaaaaatagccccactctttacaaatagtaagaaaggaactttttcctgcttccccttccgtacagatcgggctgccacatcggttacaataaatcactccgtttcgtctgctcattgatatattctccattctatcgtctgtttcgcgccgctttctgcgcatccgaaattccttaggaacttctaatatgaatccgtcaggattcattatatcattgagccgccgtgcaatcccacagggaattacagggcacagaccataattctggcatcttctctcgggaattcataaaacccccggcggatacccaccgaggaaaatccctgcttctcgtacaaacggatcgccccctcatttgacacgcgcacttcaaggacaatgcgggcaatcttgtggtctgcggcacgttttttcatctctgtgagcagcccttccccgattccacgcctgcggcacgcaggattcacagccacatttgtgatctcaccctcatcggccgcaagatacattccgatgtacccctgtatgacacccgattcctctgccaccagaaagatcgtgtcgggcagacaaagcgaatccaaaaaagcattctcactccacggctgcgaaaaaatctccgcctccagagacgccaccttcgccgcatcttccgctgtcatgctccggataatactcatacgttttcctttccttttgcggcttcctgctccttgcgctctctttccgcctgggacagccggagatattccgggcggtgttccgccgcgctctccgtttttccctctctgtaatactgcatgccaagcacagcaaccgcgccggcccgctgcttgttcagatgtgcgggcgcataggaatgcggcaccgtaagctgctcctccagatatgccttaaaaaccggtacaccgtctcccaaaaatacgaccgcctcacctctgctgttgatgtccgccgcaatctcatcgattcccacggcacactctccgcgcagcacctgcatgtcgtttccatcaaaacggtacaaaccggtataggtctgatttcttcttgcgtccataagcgggcataccatatcccggtgtcccaccagattgtatgcaagtgcgtccaccgtcggcacattgaggatcggcttctccaacgcgagtcccagaccttttgccgtcgccgaaccaatccgaagtcccgtaaatgagcccggtccgcctgcaaccgcgattgcatcgatactcgaaagatccagttcgatcatgcgcgccacctcatccagcatgggaagaagggtctgtgaatgtgtctttttatagtttacggtatattctcccagaaggttgtcatcctccgcgattgcaacgctcgccaccagaccggaactgtccaatcctaatattttcattttctgtcctcctgatgctctcttatggtaattctgcgataatcaaatcccatttccagatctttttctatagtaacttcgctgcgccgctccggcaaaatctcttcgatcagattcgcccactcgatcatgcacagaccatccccgtagaaataatcctcgtagccgatctcatccatctcctcgatgtccccgatgcggtaaacgtcgaaatgataaaacggcatcctgccctcctcatatacctgcacgattgtaaaggtcgggctggagactggctccgtgatgccaagtccttccgcaattccctgtgtgaagactgtctttccgacgcccagatctcccaccagcgtatagacgtcgccgggctttgcctccgcgcccaggcgttttccaagcgcgtgcgtctcttccggcgaatatgtttcatagatcttttctgtcatattttaaaatccccattctctacttcatcttcaaacggtacgccggcagatgtgccgcagcctgtgtctgcagtgccgcgtagctttcccccagctgtgctctcggaatgacataggcattgatcctgctgctgtacaccagaacgttgtgcttcgtcgcgaccattttatagatctgctcccacggaagcagcgcactctcttccttctgcgatacgtgcagcccctcctcgtccacctcatagtgcagcgttccccgcagcacctcggacattgccagtgtgcgcttcgaccttaggtacaggctcaccggaggatagaccagaaatacgatgccaaatacaatatataatgcggtgtatgccgcctcgatcttcccgcgggtcactcctgccaccacaaaaatcaggatggaaaacgcaatggaaaaccacccgtgaaatccggagtaggtctggtacatattaaaccggtacatatcttctgctgtcaatgtaatatcaaactttagcggcataacatttcctcctgtctatatctaagctagtatagcatttttcattccaaaagaaaaggggctgtcgtctaagacagccccttttctagcggttcgctcctttcagaatcggcgaaatgtgtttgtataccaagaatgtgattaccacggaaaacagtcccttcacgatggtaaacggcatattgaagcacaccaggcactgcagaatgctcttcatggatggtacgatcacctgataagcgccgagcacagcttcttccggcataaagttgtagtataccggatataccaggaagtagttggataccacggaaaatacacccatgatcaccgcaccgaacagggatccaatcaatgcgcttctgcggctctttttgtggcggtaaatcaatcctgccggaagtacgaatgctacgcccagaaggaagttggaaagctcaccgacgccgccggttgttgtaataaacagatgaagcacattcttgatcagacagatcagaatgccgcataccggtcccatggaaaatgcaccgatcagtgccgggagctctgagagatccatcttgatgaaagccggcataaacggaacggaaaaatccaggaacattaaaataaatgctactgcggaaagcattgccgtgacgctcatgtagcgaacgctcgaaatactgtttattgttgtcctacctgtgattgtactgtttgtgtccataatgactcgtctccttttctctgcaggaattcgaggtattctcgcgtgtcagccgtctttcaacggattgcattccggcagcggaacagcgcttattcccgccacacaaaaagccccggatgatctctacatccggggcgttaaattgcattcttaagaccctgctgccgcaggtcctcctaacatgcttctcttctctcatccagactatactgtcggtcccggattcacaccggctcaactgcaactgcagctcacggactgatctggcgtctgccagaatcaccgtcggtcgggaatctatgcttccatctctgtgaactcatatcaccctgccccgaagaattcctaatatttattttgcttctatattgtatgcccatatgggcatactgtcaaccctttttctctatccgttcagcttcatcgtcagctggatgcgctgctttttcggatcaacgcttaatactttcacttccacaatatccccgacgctgacaacttcgagcgggtgcttgataaacttgtcgctcatctgtgaaatatgcaccagtccgtcctgatgaacaccaatatcgacaaacgcgccaaaatcaatgacgttgcgcacggttcctttcagaatcatccccggcgtcaggtctttgatctcaagcacatcgctgcgcagaatcggctttggcatgtcctctctcgggtctctcgccggcttctccagctccttgacgatgtcctgcagcgtcatctctcccacacccagttcttccgagagttttttgtagtcatggatctttttggaaatgccctctaccttccgctcttttacgtcagataacgtataatccagccgcttcagaagcttcttcgtggcatcatagctctccgggtgcacaccggtcgcatcgagcggattctttccgtcaccgatccgcaggaatcctgcgcactgttcatacgccttcggtcccagcttcggcaccttcaaaagtcctgcacgggatacaaatctgccgttttcctcgcggtaggttacaatattttttgccagcgtcttgctgatgccggagacgtattccagaagcgatgccgatgcagtgttcaaatccacgccgactttgttcacgcaatcctcgaccacgccgccaagtgcttcgcccagctttttctggttcatgtcatgctgatactgtcccacaccgatggacttcggatcgattttaacaagctccgccaacggatcctgcagacggcgcgccatggacgctgcgcttcgctgtcccacgtcaaaattcgggaattcctccgtggcaagcttgctggcagaatagactgacgcgcccgcctcattgacaataatgtactgtacttttaccggaagttcctttaacaggtccacaatgatctgttcggattcccgcgatgccgttccgtttccaagggaaatcagggtaatgtgatatttggcaatcaatttctttaataccgcttttgcctccgccactttattctgcggagccgtcggataaatcaccgtcgtatcaagcacttttccggtcggatctaccacagcaagcttacagcctgtccgaaacgccgggtcccatccgagcaccacctgtccggcaatcggcggctgcatcagcagctgctctaagttctttccgaatacacggatggcgccgtcctccgcacgctcggtcaggttactccggatctcacgctcgatcgccggtgcaatcagacggtcataggcgtctctcaccacatcgcgcagcacctcattcgtctgcgggttgtcccggacaatcacctttttctccagatagcgcagaatgtcctcctgcggcgcttcgatcttcacggtgaggaatttttctttttctccgcggttcaccgccagaatccggtgtccggcaagctttgccaccggctcgtcaaaatcgtaatacatctcatagacggactccgtctccgggtctttggcagtagaggtcatccggccttttttcaccgtgaggtcacggatgtgcgtacggtaatccgcctcgtcagagatggactccgcaataatatccgacgctcccgcaatcgcctcctcggcggttgtaactcccttttcggcatccacgtattttgcctcctcttctatgagcggcgtttttatcatctgcagtgtaatcacaccggcaagcggttccagtcccttttccttggcgatcgtggcgcgcgttctgcgcttcggcttgtacgggcggtataaatcctccagcagaaccatcgtctccgccgaaaggatctgcgctttcagttcgtccgtcagcttcccctgctcctcaatgctggcgaacaccgtctccttgcgctcctccagtcctcttaaataggtaaggcgctccgacaggttacgaagcacctcatcgtttaatgcgccggtcgcctccttccggtaacgcgcaataaaaggaatggtattgccttcatcgatcagcttgactgctgcctctgtctgatggcgcttaattcccagttcctcagaaatttttgcaataatatccatatctgtcctccaaattttaccgagtctgctcccagtataccgaaaatccgctgtaatctcaagtgccttcctcattgtctttttggctttcccatgttacaatagacaaagttatcctgcgatatactggcaataccggcatatcgggaaaggtctgattatcatgaacaacaaacgacgttcccagcgaatggaaaatgccgctctgcttctcggcgtgatcggggcagctactttttgtctggtctatccggcactgatctgcggatctcttgccatcgtttttgcacttttatcccggggcggcgagcgcacgctgacctcccgcgcgaaaattgctctgatccttggcgccattgccctgggcattgtcctcgccatgattatttacacatttgcgattgccgaattatattatggcggcgtggaaaatatggcgcgtcaggtatacggcacgctcggcatcgattttgatacactgatgaattccctaggccagtaaatccacatgccacacaaacagggcaagatttttgaccaggcagttgaccacgatcaaaagcagggcgatccatatatagacatcacgaaagcgcagggcaatccgtatccggcttccgctcacgcgttcaatggtctggctgatcataaaccagccgctaagcagcgccgcatacggcacaaacgggtgcagcacaaaggagcgcagccatttgccggcaagcagcgccctgacggctcttgtcccgccgcacccggggcagtacgctccggtcagcgcatgaaacgggcagggcagcaaaaatttccagaccggaattcctgttactctgacaaacaaaaacagcgccgcgaaaattcccgccgcgcaccagcccataatataaaaatcccggtctacccgtctatccgtctgaaacattccgatctccattcctatcttactccctgctattataaccgccgcattttcggttgtaaagcacgcgcacgtttctggattccaaatctctttaactgccagtagcatatcacggtcttccatgctataatgaactctggcgagttcatattagaagttcctgcggaacttcggatgcgcaaaaatctgcgcagatacagggaaataatgttcgcgaaagcaatgagcagtgccatccatgaatgttacaaaatccggctgcttgcagacaatattttgtaacattcatggatgatagggcgaatgcccgtgagtttgaaaatgccttgcattttcaaacccacaggcactgcgtaactataggaatataatgttcgcgaaagcaaaactttcaccagaacatacacaaatatcacatccacaggagtctacacatgtcaagatcatccagcgaattaaaacgtatttcacgcgacattttaaataaccgttattccgtaccgatggcagcatttctgactgcctccttaattccgacgctcatcgagattccgttctccatgacgctcggcgattatcccggcactccgcagcttatcatcagcacgattgcagatattttaattcttctgatcgcccagatgctagagaccggcgttatgctggttcatatgaatatgacgcgcggtcagacataccgcatccgtgatgtttttacaccgtttcgcaatggcgcagagcgcttctttctcgctgccgttctcttcgatgtatttctggtgatcgcaggtattcctgccattgccggtgttctttatttttataaaaccggtgtctccggtctctccggtgccctgcttgctgccggaagcatcctcggtctgatttttactttctgtgtgttgcttacctaccgcatggttttcttctttcttttagaccatccgcatttaagcgtgcgggatgcttttcgcacctgccgtaaatttatgcgcggacgacgcaggaagctgctttacattttattcagctttctcggctggggcgcgcttgccatctgctcttttggcattgcggctctctggatcagtccttatatgacgcagacgctgctcactttctatctcgacggtaccggcgaactggaccagattcccgtccgtgattacgatcaggaggcaagacgtttcaccggatctattttttgatatcttatggcaaatcagaagttctgatttgccatttgtatatacgcaactaccaatcattttacatcaggaggagtttactatgaacgaaaaagacggagcaatccgcgacgccagcgtacttggcgtaccaaaaatgctgattcttggcctgcagcatatgtttgccatgttcggcgcaaccattcttgtaccaattcttgtcaacagctacttcggcgaagatgttctacatgtacaggttacattgatctgtgccggtatcggaactttatttttccatctatgttccaaattcaaggttccggcgtttctcggttcttcctttgccttcctcggcggttttgccacgattgcaaacatggattccggtgtattcgccgacatgtccaacgctgacaaactttcctatgcctgcggtggaattgttgtcgcgggtcttttatatctgattctcgcgctgattatcaagcttgtcggtgtcaagaaggtcatgcgttttcttccgccggtcgtaaccggtccgatcatcatctgcatcggactgagccttgccggttctgccatcaacaacgcttccaccaactggcttctcgccctcatcgctctggttacgatcattattttcaatatctggggcaggggaatgtttaagatcatcccgattctgatgggcatcattatttcttatattgccgcattgatcttcaacgccatgggcatgacaaacgcagacggctccgccattctttcttttaccgacatcgcaaacgcttcctgggtcggcgtaccggcattttccctctgcaaattcaatctgtccgccattttggtcatggctccgatcgcactcgcaaccatgatggaacacattggcgatatttctgccatctccgcgacggttgatcagaattttatcgaagatccaggacttcaccgcaccctgatcggtgacggactcgccacttccctgtccgctctcgtcggaggtcccgcaaacaccacctacggcgaaaataccggcgtgctcgagctgagcaaggtatacgatccaaaggtcatccgcatcgcagcctgctacgccatcatcttaagctttattccgaagatggctgctgtgatcggttccatgccgtccgctatcatcggcggtgtcagcttcatgctctacggtatgatctccgccatcggcgtccgcaatgttgtggaaaatcatgtggattttacgcagtcacgcaatctgatcatcgcaggcgtgatcttcgtgtgcggtcttggtttctccgacggtcttacctttacgatcgccggaacctccgtcacactcaccgcgctggcagtcgcagcgatcgcaggtattttcttaaatgccatcctgccgggcaacgactatcacttcggaaaagacatcacaggtgacgcgaaccgcggtattgacatgaagccgaatcttcacgaagataccagctacacggatacagaggaataaaaatgccgcagaaagtggatgcggcagggatcgaagccggatcataaaaacgttttctaacgtttcaggatgcaaccggcggcggtcattctgatcgcataatccggtatttctaatccgcaccgcgtttgacatccacgatgatccgtgtctttccaagttttgagcactccgcgaaatgtgtccgcactccgcagacaatttaaggactttcgtgtgtgccccttgtcgacaccgctgaacaaaacataaccgcgcgaagccgatgtctgagttggcatctgccctattttcaatagcagatgccagcgagtttcggttcgcgcggttttatattgtctgtgaagcggtgccgctaggggcaccaggaagtccgctcattgtctgcggcgtgacgaacacatcccgcggattgtcaaaacgtggccaagacacagaatccgatgtcaaacgcgctgcggaagaaatacaaggattttgctccaaagaatggaccgtctccggttgcactctgaaacgttgtaaacctttttacatgatgcccgcgatccccaccgcttccgctttccgcggtatttatcagatgtagtgcagatgaatctctccgaagttcgcggagccattcagatacagcaccgtgctgctcgttccgatgctgctgccggtttcacggatggcgccgaacgaacggtccagattattctgaatcttccattctttcgggatgtaaaggttagtctccccgaaattattctccacgctcacatttgcagagccttcctgcacgatcgcattgtcgaagtacaccgaaagcgatccgaaattattttcgatggcggcgcgtctgaagttgtcggagttgatgtagcggattgcggaaccgaagctgttctcgcaccggatctcttcgccggtatactgttcactgctggatgttcccacattgccggtcaccgtcttccatttccgctttttcccgccaaagatcaatgacagaccgatgctcccaaggaatgccgcgccgagcaccgtccacggcgtgagtgctgtaattccaagcggcttatcatagatgatacagataaacgcaatcgagaacagaatctcccagaaattcacattgcggattccctcgacaaaaagccagaggaaaaatacggtcagaataatgctgaacacgccgatatccggcagaattccaaacttgcttataacgacatacactgctgcgaggataaaaaagattccccagaatactttgctacttttcatgatgcaacctcttttcttctaatttttgagtcaacggtttatagtaataccgcgatacatagaccttcttgtgcgtgtttaaaaacgccaccacacttgacgccgtcagattgcggtcaatagagtaaatctgatccgtgtttaagatcgtggatttggatactctcataaaaacgcccggaagcatatcttccagctcgtatagtttgtaccgggtctgatacatctcatcccgggtgtgtgcgctgatcccgttctcgtctgtctcgaaaaacaggatcttggacaatgtcacatagtattccgtgttccctttataaagcaggatcttctcggaagcgttggtgacatcccgcacggcgcgctgcacggcagcgacctgtttcgtcagaccgcggcagcggataatcacttcatcctccgcggcgctctcgtcaatctcaatttttattttcatctctgtaactcctttgatggttccagtataaaaaaagaacctcccggtgtaaacagttttacaccaagaggttattttctccgggtaagtggtaacactttcccgttcctgtcacattaaagtgtctttaacttctctacgcccgcatccagataagcgttctccatcgttgcaaacgctcccttgtctgcctgctccgcaaacgccggatcaagcggaagctttccgaataccgggatcccgagctcttttgcgacatcgtcgatatgactctcgccaaacagcttaatctcttttccgcagtccggacacttcaggtagctgaaattctccaccagaccgagcaccggcacatgcatcatctccgccatgttgtacgcctttttcacaatcatctgcacgagttcctgcggggacgtcacaatcacgattccgtctaccggaagcgactggaacaccgtaagcggtacatcgccggttccaggcggcatatccacgaacagatagtccacgtctccccagactgtctcgttccagaactgttttaccacgccggcaatcaccggacctctccagatgacaggtgcctcctcgtcatccaacagcaggttgatcgacatgatcttgatgccgttctccgtctccatcggaaccattccgtcgtccgttccgtatacctgtccatgaattccgaacatcttaggaatcgacggaccggtaatatccgcgtccatgatgcctaccttgtatccggcgcggttcatcgctgcagcgagtgatgctgtgacaaatgatttgccgacgccgccttttccgctgacaacaccgatcactttcttaacgttggatgccgcattcatcggctccttggcaattccgccgcctgctttattcttcgcgttgctcggacatccctcgcagctctcctttgagcagctggacgctccgctgcaattactgttctctggcatattctttcctccttaaatcgcttacatcttctctatcaggcttcttttttctctctggcacgcttttccttttctgcaaaaatcgccaccagcgactccgtgtaaggcgctctcgccacaccgtattcggtaacgatgcctgcaatcagctcatgatccgtcacatcaaatgccgggttgaagaccttgacgccctccggtgccatgcgctccttgtaccacatttccgtgacttcctccgccggacgctgctcgatcgtaatcccggctccggtcggcgtatttaagtcgatcgttgacgtcggcgcgcagatatacaccggcacaccgtaatattttgccacagccgccactacggacgtaccgatcttattcgccgcatctccgttcgcagccacacggtcacacccgacaaataccgcattgacccagccgttcttcatgactgtcgccgacatattgtcacagatcagtgtgacatccacaccggaagactgaagttcaaatgctgtcagtctggcgccctgcaatagaggtctggtctcatctgcaaatacatgaaaatgatagcctcgttcctctcccagatagatcggcgccgtcgcggtgccatatttactcgtggcgagctgtcctgcattgcagtgcgtcagaatgccatcccccggctttaccagagtcagaccatgctctccgatcatccggcacacccagatatcttcctcctggatcgccacagactcccggtgcagtgcctccttgatctgcgctacagtctccccactgtgtgcctccacaacacgctgcatccggtttaacgcccagcttaagttcacggctgtcgggcgcgaagaatccagatactccttctgccgtacaaactcacggtaaaatatatcgtaatcctccgtatccatccgttttgccagcacatagatcccatatgccgccgccactccgatcgccggtgctccgcgcacctgaagcagatagatcgcgttccagatttcctgcgccgtgtgaagcgaaatgatctctatttttcccggcagcttcgtctggtcgatgatcaccactgcattgttctcatcatccagccgcacggtgtcataatccataatattcctgctctgctgttctcccacactttcacccctttattcttattcatcacagactattatactctcttttgtcgatgtttccaagaatacgcccgccttctcgtgttcttttttgcggacaaaaaaggaattgccgcaataagcatagatcgtttgggtgataagtaataatatgagaagaccacaccgtgggatttcagatggaaatacaaatggaaattcgttggagaaaaatgtgtgcatttctttctgctgaatgtttgcatcggattccgtgtctcttccacgtttggaaaatccgacgggtgcatgtccgacacaccggagacaatgggcggactttctggtgtccctaatggcacctcttcacagacagtataaaaccgcgcgaaccgaaactcgccggcatctgctattgaaaataaggcagatgccgactcagacatcggcttcgcgcggttatgttttgctcagaggtgtcataagggacacacacaaaagtcctacaaattgtcttccgggatgcggacatgacccgcggagtactccaaacttggaaagacacggatcatcaaagatgcaaacattcggctggttagaaatccacattttttgaaccgaatttccagctgcatttccacatgaaatccccaagtgtatttcttctcgtaatattacttattgttcctagtagcggagtgcttttttcagtgccatggaaaccgctgttccgataacgaaacatacgatcgcctcgacaacgccgttcacgccgacaaatgctgcgataaacgggatcactttcgtcatgccgaactgctcacgcattgttcctgcgaacagagttaccagtgttcccatgaaaaatgtggtgttcagcagcggacagcaaaggctggcaagcgttaccgaacctgcggaaggtattttcgtcttcttcagtcccttgtagatcagtccggtcagccatccgtccagaatacgtgtcggcacacataccagaaatgtgaataccgggtttacgcccagaaggagcgtaccaaacgcgctcattccaaaacactggataaaactcgtgataccgaacacaccgcctaagattgctcctgccgccggtcccaatgttacagctcctaccgcaactggtatgacaatcagggtaatctcaagacctgctgtctttatgtaaccaatcggggtaaaagccatgagtaagatgatggcaaccaaaagcgccatctccacgagatacttcgtagaaaatttcgacttcgtcatagtcttttcctcttttctgtatactttgtttatggttcctgtctgccaggaactttttgcatcttttgcagtatatcactatgtgaaatatttatcaagcggttggcgccacaagaccacattttttccgccaggttcccgccagatatcttcccacaaaacagagtacacggaacacccagtcaattaccatggcagcccacaccccgactgccatccatcccatgtgaacaccaaacacataactgaagccgatacggaaggtaatcatggaaaaaatcgacacgaccatcgtgtattttacatcgttgcaggcgcggagcatattcggcagcacaaacgacgccggccacaggaagatcgccattccatcatgaatcatgaccagaatgtaggacaggcgcgtcgtctcctctcccagtccatagatctgtaaaatccacggcagcagaagtaaaatgatgctgttgatgaccgccgtataaaaataggtctctcccagcagctttttggtgtaatagcgcacctgtccttcttctccggctcccacacagcgtccgatcacagtaatcatcgcaaggctcatcgcctgtcccacaatacatcccatggaatccagactgttcgccaccccgttcgccgcgatctggctggtgccgaacgcagctatgatgctgaccacaagcacacgtcccagctggaagataccgttttcaattccgctcgggatgccgataaaaagaatccgcttcacaatcgttgcgtccactttaaattttcctctggtgagaaagaccagattgtccggattatgcaaaagcgtaaaaagcaccactcctgccacaccgcgggaaaccaacgacggaatggcgactcccgctactcccagtttcagcacatacacgccgattgcatttcccacaacgttgatgacattcatcagcagcgatattttcaatgtgatctgcgcattccccatcgaacggtacagcgccgcacacgagtcatacactgcgagaagcggaaatgagaacacggagataatgagatagatgatcgcattctgcataacatccgcctcaatctgtccgaagaataatccgaggatctgcctgtgaaaaagaagtaccagtacactgataccgatcgtgatcgccgcctctgtaaacacaagctgtctggcagaccgacaggcttcctctctccttcccgcaccgatacactgtgacgttaccaccgcaccgccggtcgcaagcgccgccagcacactgatgattaagttgttaaacatgtctaccagcgacacgccggaaactgccgcttctcccgcagaagaaatcatcatcgtatctgccattcccacggtgatggcaagcgtctgttctaagatcagcggaataatcagtttccgcaaatcttttttactgaataatcgattttctgttactgtctgtctcacgttctttcactccttcggaatgacaataatacgcaaaacggcaactgtcaagctcgtgaaataaaaacataaaaactcccgcatgacagacgccacatctgccacgcgggagttcttttcacctatgtacttttctttgcttatttgccaagttctgcctttaacgcagtggtcagtgccggaacgatcttgttgagatctcctaccagaccataatctgcaacgtcgaagatcggcgcatcctcatccttgttgatagcaacgatgagatcagaatcctccatacctgcaacgtgctggatagctcctgaaataccgattgcgaagtagatctgcggacgtactgtcttacctgtctgtcctacctgtaaatctaccggcagccagccgttctccactacggcacgggagcagcttacggtaccgccaagtacctctgccagatcctcgagaagcttgaagttctccttggaaccaacaccacgtccaccggataccaggatctttgcatccatgatgttcgctgtattcttaacagcctttacaatgtttaagatctctacatatctgtcattcggggtgaatcccggattgtactctaccacatttgccttagcgcctgcgatcggagcgatcttctgcataacacccggacgtacagtagccatctgcggacggttgtacgggcacgcgatcgttgcgatcgtgttaccaccaaatgcaggacgtgtcataagaagctgattgtgctgctgctcctgtccagctgctgcgttcagcgggaaatcgccgatctcaagcatcgtacagtcagcagtaagacctgtcttcacacgagcggaaacagtaggtccgaggtcacggccgattgcagttgcgccaaccagcatgatctccggcttgtactcattgatcacagatgccagtgcatgtgcgtacggctctgttctgtagtcttttaactgcggatcgtctaccacgatgactctgtcagcgccgtactcagcaagctgatctgccagctccttaacgccggagccaatcaatactgcagttacttctgtgtttaaatcctttgccagctcttttccttttccaagtaactcgaaagcaacgccgtctaatacgttgtcaacctgctgtgcaaagacaaatactcctttatattcttctaaacccattttattcaccacttttccttatatttgttagataatgtgcttctctttgaacttgccgatcaggtatgctacggactcatccggatcaaggacaaccttctcgcctgcgcccttacgtaccttgtcagatgcctttgcgatctttgtcggtgatccctttaatccaagatcagaatcatctacatccttaagatctgctcttccccatacggtaacttccttatcgtatgcgtcgaagattccgcccggagtcatgtaacgcggctgattcagttcggaaagtgctgtgatcaggcacggcatctttgcctttaactcatggtatctgtcctcgtactgacgctgaacaacgacatattctccatcgatcttgatgtcctgtgcgtaggaaataaccggaagtcccagatgctctgcgatctgcggtcctacctgagcggtatcaccatcgatcgcctgacgtccggtgatgatcagatcgtaatccagattgcggagtgcgcctgcgattgtggtggaggtagcccatgtatcagctccgcctaacacacgatctgttacaaggattcctttgtctgcgcccattgccattgcctcacgaagcacctcgtctgccttcggaagacccatggtaagaacggttacttctgcgccgtactgctcttttaatctaagtgctgcctcaagacctgctttgtcatccgggttcatgatggtaagcattgcagctctgtctaatgtaccgtccgggttgaacttaacgccgcccttggtatctggtacctgtttaatacatactacgatattcatgtatttttcactccttatatttttatattatgccacggattacgactatttcagtaatgcaccagagataaccattctctgaacctcactggttccctcgtagatctctgtgatctttgcgtcacgcatcatacgctctacatcgtactctctgatgtaaccgtatccaccaaacagctggacaacctctgtggtaacagccatagcagtctctgctgcgaacagttttgcctttgcagcctctacagaatataccttctgtgttgcctttgccatagcagctttgtatacaagaagctgtgcagcctcaattcttgcagccatgtcagccagcttgaactgtgtattctgctgctgggcaatcgtacggccgaactgttttctctccttggtgtatgcgattgcgcggtctaatgcgccctctgcgataccaagtgcctgagcagcaataccgatacgtccgccatccagtgtgtgcatagcgatcgggaatcccttgccctctacgccaagcaggttctccttcgggattctgcaatcctcgaagatcagctcgtatgtagatgatccgcggatacccatcttcttctccttggttccgaaggagaagcccggagctcccttatctacgataaatgcagagaagttcttcttctttctgcctctcttatcctctgttacgcttgtgattgcgattacgatataaacatctgcaaccttaccatttgtgatgaagcacttggagccgtttaatacccactcgtctccgtctaatacagccttggtctgtgcgccctgcgcatcggttcctgcacccggctcagtcagtgcgaatgcaccgagcttctcgcctgttgcaagcggcttaacgtatttctgcttctgatcctctgtaccgtaggtcataatcggatcaatgcagagagaagtatgtgcagaaacaataacacctgttgtagcgcataccttggacagctcctctacgcacattacataggtgagcgggtcacagccctgtccgccgtactccttcggtaccgggatgcccatgaagccgagcttctgcatcttcttcacgttctcaaccgggaattcctctgtctcatctacttcctgagcgagaggctttacctcgttctcagcgaactctctgaacagggagcgcgccatttcatgtttcttgtctaaagtgaaatccatgatatcatttcctccattattaccttatattttactgagcatcaaccggggtctttgtacggtcagcattgtatacatagaatcccttgccgctctttgcgccaagattgccgccgcgaaccatcttgcggattaacgggcatgcgcggtacttgctgtcgcctgtctctttgtagagaacatccatgattgcaaggcagatatccagaccaataaaatcacctaactcaagcggtcccatcggatgatttgcgccgagtttcattgctgcatcgatacctgcgatatcagatacaccttccatcttaatgaaagctgcctcattgatcatcgggattaaaatacggtttacaacgaagcctgctgcctcatttacctgtaccggagtcttgccgatctctacggaaatcttcttgatcgcctcaacggtctcttccggtgtattcacacctgcgataacctcgattaacttcatacggtctgccgggttgaagaaatgcatacctaccattggacgggtcagtccgttgccgatctctgtgatggaaaggctggatgtgttggatgcaaaaatgcactctggctttgcaatcttatccagctcctggaatgtagtcttcttaacgcccatatcctcgaaagccgcctctacgatgaggtcacaatccttgcaaaggtcttcctttaaacctggggtaatctttgcgagaatgccgtctactgcttcctgtgtcatttttcctttctcgacaagtcttgcatagcctttcttgatcttctcttttccgccgtcagcccactcctgcttgatgtcgcagagtgctacttcatatccgtctacctgggcaaatgcttttgcaataccctgtcccattgttcctgcaccaataactccaactttcatgtctgtacctcctgaaatatcatatatatattctaataactgattctatgccttttaataaaataggaacaaagattcctattacgcaaagcaagaacttctccggtgccgcccacaggctggcgccggttcagaagttctcataactgcattagtctctctcaacgatggtagagcatcccataccaccaccgatgcacagagtagcaagacctctctttgcgtctctcttctgcatctcatgtaataaggtaacaaggatacggcatccggaagctcctaccgggtgaccaagtgcgattgcaccgccgtttacgtttaccttggacatatcaaacttcagatctcttgcaactgcaacagactgtgctgcgaatgcctcgtttgcctcgatcagatccatatcatcgatggtaagtcctgttctctcaagtacctttctggtagatgcaacaggtccgacacccatgatctcaggctctactccgccgagtgctccggctacccatgttgccatcggcttaacgccaagctcttttgccttctcctcgctcataacaacgattgcagctgcaccatcgttaataccggaagcgttacctgcggttaccagtccgccctctttgccggagcaacattttaacttggacagtgactcagctgttgtgccaggacgcggtccctcatcttttgcgaacataacggtctctttcttaaccttaaccggaaccggaacgatctcgtcatcgaacttgccctcagcgattgccttctcgcacttctgctggctgtttgcggagaactcatcgagttcttctcttgtaagaccatacttctcacatacgttctcagctgtgatcatcatgtgatagtggttgaatgcatcggtgagtgcatcgtttaccatggtatcaatgatggtcgcattgttcatacgatatccaaaacgagccttcgtcatggcataaggagccatggacatgttctccataccacctgcaacaacgatatctgcctgaccagccagaatcatagtagctgcttcattgacacatttcagtccggaaccacatacaacgttcagagtaactgccggtacttcgatcggaagtcctgccttgatggaagcctgacgtgcaacgttctgtccctgtgctgcctggataacacatcccatcaatacttcatctacctgctccggctttacgccagctctgttcaatgcctctttgattacgattgatcccagctccgctgccggagtattgctcagtgctccacccatcttgccgatagcggtacggcatgcgcctgctaaaactactttctttgccattttgaattctcctttcagttttacacacaaaaccccgtatgtacggggaatttgttcctctttaaaaaataattttgccgaaaaacgctgttaattttttaacaatctttttgctaaaaaaaataaattcaactttgcagttaaaatttatgtttctccctctttttttcacaaggtgcattttaaataatcggcgtttttactagctttttaatactttttcatgctaccatatttcactcttaaatgcaataactttcttcttttttcatctttctaatgttttctttacgctcctttttccccctctatacgtctgttttacagtctttttttgttaaaaatttatcatgcaaattttattttccaaacaaaagcaaagcgattcttgtgtacttttcacaaaaatcgccctgctgccattctgcggttttccgcacttttttcacttctaatagaatacatggtttccaattacggttccctgtatgatgccgttattctgtctgaaatacaggcagcccaccgtaatattgccgtttagcacatcctgtgccgcctgaaggcagcttccgtccacacccgcttccagacgatacgccagtctgccgctcgccaccggcgagaactgaccgctctggtaaatcacacccgagacagagttcggaaaatacgaactcttcacacggtttatcacaacgcttccgaccgcaagcttcccgtcgtaggattctccgcccgcctcgcactggatgattgctccaagcaggtactggtcactgtccgtcggcacatagaccacggtggaggtatcctccttctcctgctccttaatcgccgccagacgcgcagcgtcctccttcgccttctggatctccagctgcttctcgtactcgaccatctggttgatcttatcctccaggtccgcgacgttggactgcgcatccgccagatcttcctgtgtctgcgccagattcgccttggtggtgttgatgagactgctgacgttcgcctgctttttcttcatgtcatcctgcatcgccaccagctcggtcatatcactctccagatcttccttctgggcggctatctgctcctgcagatcctggtattccacaagcttttttctgtcgtaggcgttgatgtcggtaatatattccgtgcggttcaggaagtcggaaaaagattccgcctccgcaagcatctgccataccggcgtgcttccgttctcatacatgaactgaatccgcagcttcatatcctcatactgtttcgcagactgtgcctccgccgcagccagatcctccttcgcctggtcaatctccccctgtttgtccgaaatctgcccctccagatcattgatctgtgcgacaatatcggaaagctgaccgtttaacccgctaagatccgactccagtgcatcctttttgccggagatgtcattgacggtatcctcggcatcctttttctgatctttcagatcctcaatctgattcttcgcatcatttatgttgtcctgtgtcgtctcggcataagatgtatttgccagaagcaggcacattaccagcgctgctcccgccacgcgtctccacggaatctgtatcataagtacctctttctccggaaaagtaggattttctttcaaaaaccccggttctaagagtatcatatcagattgtatttcagctttcaatatgctatcatagagggaagataaagaggattttggtatgacaataccggaagagggggagataagcatgcaatttgtcaaaactgctgatctaaagcccggtatgcgccttgcaaagccaatctacaacaggatgggggttctgttatacgaacgggatacaaggctcacgatccagggtattaacagtattgagaattttggtctgatcggcatttttattctggagccggctgaaccgctgccgccgctttcgcgggaagatctggagtttgaacagttccagaccatctacatgttcaagttaaaggacaacatggacaagcttgtcgacaatcttgtcccgtccacactgctctcgctggtcgatgatatccagcggcattacggcagtcttgaccacaagctgaattttacgcagacactccgcagttccgcggactttgtatacaaacactcgatcagtgtcggtatcctatccgcaatgatctccaatgagatgcagctcccggcagaagatatccgggcgctgatcacggcttccctgctgtatgatttcggttatctgtatgttccgcaggccatcctcgacaagggcgacgacctctcggacagcgaccagaattttatccagatgaatctggaacgcggttatgaatcaatccgcccgcgctatgaggagtgcaatcttccgaagatttccttagagattatccagcagttcatcttccagaagagtcagaccttaaagatcaaggatccttccccggagacacgtctgctctgtgatattttaaaggtggcagatcagtttgaccggcttaccgccatgaatattaacaatccgccggtctcggaggttgccgcgatgtcttttttgcgcagacacagccggacctacaatccgcgcgtcgttgccgcactggcggaatgcatccacattctcccgaccggcgcgtgcgttgatctctccgacggtgagaaggcgctcgtcctcgtggaaaatgccgcggattttacccgcccgatgatcttaaagttctccaacaatatgatctacgatctgagtgatccggtcatcggagattccctgcgtgtgacggacatcatgaaaaccatggacaaccggattgcgatcgacgaggaggcgctcgagcattttgtcgcagaccagtacatccgtgagacggctgaccgtttccggcagaaaaagcttgccatcgcacagcgcaagcagaaagctgcccagaagaagagcatggatgatcttttggacaatgccagagtgcttacacctccgcccatcgcaccagtgccggaagaggacgcttccccgatcaggaaagctccccgcaagcgcatgaaactggtttaatattttatgtgaagggtgggaacggcgtatcgttccggatgcagcccggtgtgaagcattctaaccgccaaatccggcatttctagccgcatcgtgtttgacattctcgatgatccgtgtctttccaagttttgagcactccacgaggtgtgtccgcaggttgcagacaattttaggactttcgtgtgtgtcccttactgtcatcgctgaacaaaacataaccgcgcgaagccgatgtctgagcaggtatctgccgtgtcttcaatagcagatgcctgcgagtttcggttcgcgcggttttatattgtctgtgaagcgatgacattagggacaccaggaagtccgcccattgtctgcaacctgtcggacacatcctgtggattgtcaaaacgtggcaaagacacagaataaaatgtcaaacacgacgtggaagaaatgctcgtattttgcttcaaggatgcttcacaccgggctgcatccggaacttatatcctcccccctgcatatacagcgcggttattttgcttccacataaggattgttttccgccatccggcgcgcctggcgcggagtacagtggtaacgctccttgaacatccggtaaaaaagcttctgattaaagaagccatgccgctccatgatctcctgtaccggatcgtccgtgtgcagcagatcctgatagatataattgagccgcacctgatttacatagcgcataaacgagctgccggtgctctgcttaaagaaccggcagaagtattcccggttgagccccagttcatccgccgcttcctgcagcgtcatttcttccctgtagtgatgatccacatacatacagatctgctccagccgctccatcttccccgccctcgtctgcgttgccaccatggagacaggttccgaaaaatgttccaccagacatgccagcaattccagaatccgcgccgtgctttttaaccggtacgtctcattctgattcacataaagcaccgtcagttcttttaaatacccgcagatttcattgtaatattcctgctgccctggacggagacgctgtcccgcgcagcggatcgcaaaaggttccgcctccggcagatagcgccgcagaagctgccttgacacgtggatacagattcccattgtctgcggcagcgcatagatgacttcatgaattctggcatagtccatcacaaccgcgtccaacggattcagttcgtattcctcaccctccatatgcacagtggcatgcccgtttaatatgtagagaatctccatctcccggtgccagtgaaacggagagttatgatccatcgtaacaaaccggatatcaaagccgacgtccggttcgagcgtaacattttcatatgtatttttctgttcttccattttttctcctaaaagtcaatatcacccaactttttgctaatatcttatctataatattaccatatttccgtgtattataatagctgtcaaagggaaaacctttgatgaacaagcaaaaatgtaccaattcaataaaggaggaaattattatgttagcaaaaatcaaagcattcttcatggagaatatcgacggagtcgcaatgggtgttgaagcaatgtacggagttgacattcatccatattacaactaatcccggagcaacgccatgacaacagaaaattttaccaaaaaagagcctgtaacggtgcgatgagttctcatccatccgtatacaggctctttcttatttcataagaaataccttgacacattaatgtacgaaagtaggtccttcctatgaaataagaatcgctccgcgcggatgcgcagctcgcggtatggaaaatatcgctttgcgaaccgctcgcgcgcggagaatctcgcaagcgagattcttttttttgtttataaattcttcactttcgcaatatcaaccggagtcagcgtatccatcgctgtctcaaggcttcttgcaagtgcgtttgccgtatccatcgctgtgatacagtacacgccggtctcgatcgcatttcggcggatcaaaaagccgtcgcgcgtcttgtctccattgccctgtgtcggagtatcgatcacaagatcaatcttatgaccaaggatcagatccatgacattcggggattcctgtgtaatcttattgacacgcagcgcattcaccccatgctcctgcaaatatttcgcggtgcttctggtcgcgtaaatcttgtagccgagcgcttcaaaacgctttgcaacgccaacggcctccggcttgtccgcatcctttaccgtcataatcatctgcttatattttggcagtgtcacaccggcaccaaggaaagccttatataatgcctcgttgaatgtctttgcaataccaaggcactcacctgtggacttcatctccggtccaagggaaatctccgctccgcgcagcttctcaaacgagaataccggcatcttgatggcaatgtaatcagccgtcggtgcaagtcccggctcatagccaagtccgcggattgtgtttccgataatgaccttcgttgcgagatcgacaatcggaataccggtcaccttgctgatgtacggcacggttcttgaagatctcgggtttacctcgataacatagacctcttcattcatcgcgataaactggatgttgatcagtccgatgacatgcagtgcctgtgccaggcgcttcgtatattccacgatcgtctcttttacatgatcgctgatcgtcggtgccggatagacggaaatactgtctcccgaatggacaccggttctctcgatatgctccatgatacccggaatcaggatgtccgttccatcacacacagcgtcgacctcgatctccttgccctgcagatatttatcaacaaggatcgggtgatcctgtgcaatccggttgatgatgccgatgaattcctcgatctcgtcatcgttaaatgcaatcttcatgccctgtccgccgagtacataggacgggcgcacaagcaccggatagcccagacggttcgccacttccttcgcttcctccgcggtaaataccgttccgcctgctgctctcggaattttggtcttctcgagaatctcatcgaaaagctcacgatcctccgcagcgtcgacgtcctccgccttggttccgaggatcttcacacccatcttcatcaggctctccgtcagcttgatcgcagtctgtccaccaaactgcaccaccgcaccgtccggcttctcaagttttacgatggcttccacatcctccggcgtcaatggctcaaagtacagcttatccgcaatatcaaagtctgttgatacggtctccgggttgttgttgacgatgacggtctcccagccttcttttgcgaatgcccaggtacaatgtacagagcagtaatcaaactcaattccctgtccgatacggatcggtccggaaccaagtaccagcaccttcttgttcgggtgcgtctcttccgcctcattctcgctgccgaatacggaatagtagtacggtgtggtcgcctcgaactccgccgcacaggtatctaccatcttgtatgctgccacaataccgtttgcgtagcgcatatcatggatctctgtctcggtctttccggtcagttctgcgatcaccttatccgggaactcgattcgttttgcctcttttaacagttctaccgtaagcggctcgctctttaacttctgctccatctcaaccaggattgccagcttatcgatgaaccacttatcaatcttggtgatgtcgtgaatcacatcgtaatccataccgcggcgcagtgcctctgcgatcacccagattctccggtcatccacaacgtgaagctgttttaccagttcctctctggaaagtccggtaaaatcataggacatcaggctgtccacatgctgctctaaggaacggatcgccttcatcaaggctccctcgaagttattgcagatactcataacctctccggttgccttcatctgtgtggtcagtgtacgttttgcggtaatgaatttatcgaacggcagtctcggaatcttgacaacgcagtagtcaagcatcggctcaaagcttgcgtaggtttttccggtgatggcgttcttgatctcgtcaagcgtatagccaagcgcgatctttgcagcaacttttgcaatcggataaccggtcgccttggatgcaagcgcggaggaacgggacacacgcgggtttacctcgatgacgcaatactcaaagctctccggattgagtgcatactgcacgttacatccgcccgtgatatttaattcagatataatatttaaagcagaggtacggagcatctgatattccttgtcgcccagcgtctgtgacggtgcgactacgatggaatcgccggtatgcacgccgaccggatcaatgttctccatgttacataccgtgatgcagttgccattcgcatcacgcattacctcatactcgatctctttccagcctgcgatgcagcgctccacgagcacctctccgacacggcttaaacggagtccgtttgtcaggatctcgatcagctcggtctcatcgtgtgcaataccgccgccgcttccgccaagcgtgtacgccgggcggagcacaaccggatagccgatggtgtttgtgaacttaataccatcctgcacattgtgcacgacctcggatgccgcacaaggctctccgatcttctccatcgtgtctttgaatgcctggcggtcttccgctttgaaaatggtctctgcggtcgtaccgatcagcttcacgccgtacttatccagaattcctttctcggaaagctccatgccgagatttaatccggcctgtccgccaagggtcggaaggatggaatccggcttttcctttgcaatgatctgctctaacaccggcacggtgagcggctcgatgtagacctgatctgcaatgtctttatccgtcatgatagtcgccgggttggaattgaccagaacaacttccacgccctcttccttcagggaacggcatgcctgtgttcctgcatagtcgaactccgccgcctgtccgatgacaatcggaccggaaccgattacaagtaccttcttaatctcctgatttcttggcattatttcgctcctcccatcatgtttataaatctgtcaaacagatatgcagaatcctgcggtcccggacacgcttccggatggaactgcaccgtgaaaatgttcttgccgacataggaaagtccctcgttcgttccgtcgttgacattgacaaatgctggtgtcgccaccttcggatccagagtatcggtgtctaccacatagccgtgattctgtgaagaaatgtagacgcggttcgtcgccagatccttgaccggatgattgcctccgcggtgtccgtacttcatcttgtgcgtgtcagcccccgttgcaagcgccatgagctgatgtcccaggcagattgcaaaaatcggcgtatcggattcatacagcttgcggatctctgcaatgatctccttgcactctttcgggtctcccggtccgttgcttaacataatgccgtccgggttcgccgccagaatctcctccgcagaagtatgtgccgggtataccgtcacctcacagcctctctctcgtaaggactggacaatattgcgctttgctccaaggtcaagaagcgccacttttttcgtctcaggggcatttccctgcttttttaatactcgtttttccgtacaggtaactttatctaccacgttgcctgtcgtgtatgcttttaatttaggaatgatttcttctatattatagttctcattcgtcgtgatcataccgttcatcgttcccttctcacgaaggatcttggtaagcgcacgcgtatcaattccggcaattcccggaatatcgtattttgcgagaaaatcctgaatcgtcccctcgcaccggaaattgctcggcattctggacagttccctcacgatataaccgtccggccacggccgtcccgactccatatccggcgtgattccgtaatttccaatcagcggataggtcatcacaactgcctgtcccgcataggacggatcggtcagaacctccagataaccggtcatcgatgtgttaaacacgatctcactgatgacctctctggtggaaccaatgctggttcctgtaaatacattcccatcttcgagtatcaaaaaagctttcattcgtctccctgtcctttcacttttttcccaaaaaaaaaaacgtttccgtttttcttcttttttccagaacgcacatgcacacggtgtgtgatgcatcgtcttcgtgccattatgggcagtgctatgcctttttcctaaattgtaaaaagtttatcatatcacaggatatttttcaacctttttccggaaccaaataatgtataatttttacactgtgatgtataaaaattatacattatggacaaattggacgttcatcgtcctatatcaacaatatgatcccaccgacacaatggcgtttcatgcgaaatcagcaatataatgtgttccttttttcgttgctctaactccttatagaagataattttactttcttcatcaaggtttgctgtcggttcatctaaaatccatatgcatgaatccgataacaatgttctgacaattgctatcttttgcttttctccccctgaatatatcttattctctctatgctttgtactatccatatctacaaacttcatcagcgaatccaatttcatttggctcactaatgctttcaattcatccatatctatccgattccccttcaaacatatattctcttgaattgttccatcaaatatatagggatcctgctctataacagccgtattgttgttaataaaccacttataatccaattcacccagtctgtagccattatatatcacttgccccgtatacgaggttccataaattccaagcattatattaacaagagatgattttcccaccccatttctacctctgatccaatatatctttcccatgcaaaattccgttgtaatgtcaaaaagtctattttgtccaggataagcaaattccaaattttttaattctattttctcaattatcctttgcctttcttttcctgtcggaatttcatctaatactaaatatttttttaatcgttcttcgcttgcctttaccgtctgataagaacttcctatattcaagaaaaattccatacaccccaatacatatacaaaataatttagcataacaaccaatgttcctacagacatactatccatttgaatcattctgccgcctgctaaaaataatgcggtctgaaatatcaatatcaatatatcttttagaacattatatatgctgtatgctccaatttgtttttttaaaacgcgcaacaaattctgatagtcattctccatacatccgaaatgatattgactcatcccattcatacgaatagataccgacttttcaattagctcgaacaatgttgtagcataatttgttttttgttcaataacctccttttctgtccggtatatcagcttttttgaaattaaataaacgcccgtgtatgcaatcatcatcaatataacaagactccctattaacaaggagttttttatcagcaccaaaagatacacaattgtagaaaccgtctgaacaattatatttttaaaaaaagatacataaaatgatgctattatcccagtatcattattaatcttctggcttattgctgccggattttccttgcaatagtttaaatacgaagtattatatactattttcagcactttccgtgtcatgccataacttaattttccctcaatagacacccgctgatattccattcgtatgtagcatatcctatttattatattcaatcccacatacaccacaatatattccacccattccctctcttggcatgaagctataatcagatccaggaaatgtcccacaagataagttaaacaaattcccactactccagagatagtgcttattatgatatatcccgtcaactgctttttttcaagttcaggatataccaattcatgaaaccccgtcatcatctagtcctctcttatacggatcagaatacagcctgccaacagcataagcaacgttaaggcagaaagctgtggcagccattccacgatgcctttaccggttccatctgaggctgtcgtttgaacaatccctgtcatacaaaaagctgcacatatcatcaatgcgttcattttcgtttttacaataaaagaaatgagcagaactgcagccgtcagaaaaactatatacagaagcattcctaatatttcttctcgcacaagactccatatcgatatcaccgtctgcgtcccttgttcagaaatcaccagaagcatctgtcctccggttccatatcgtgctgttccaagcagaaataatatgcctgccgcactgccaacacatacgacactcaccagtacacgtacaaaaaatcgttccagatacaaccattccttttttattggcaggatgtatagtctgtaacaagttgcatattcaaattcattcgcccacgcatcaaaatgcagcaaaataatcaaaactgtaaaaatcaaaaataatacactgtttccagaaaaagcctctttccataaccatgcagcctgaggcacaaccggacagaccggttcctctgttccgctctgctgatatgctttatgtaacagcatacgtgctctccaatcagcaacactccctctgaatatgcccgtatactccacttcctctcccagttcctcaatcgctattaaattttcgtcttcctccagcaccgtcctgcgaattccattctcatcccaagcctgttcccaataataacgcaaccgaatattggtctgttcgtactgtttccatgcatttagcaataaactggcatgtgcaaatttttctgcactattgtccccccatagttccatgcactgcctctgatactcagattcccagatcgtaatatcttttgcattttcttccagttcttccaacactgtctgcgcataattctcatactgtgtaacatagtaaaatctatatgcaaaaacaaccgccagcgcccctactatccagaccaagtaatttttccggctaaagaaaagctgtatttcattttgcaaaaatgctttcattcttatctgctccatacaaatttttgtaaaattcttcaagattttcaaacctgcctgaaagatcatcaagctttccatcaaaacaaacaatgccatcgtcaatagcaacgattcgatctgcaatcttttccatttccgaaagttgatgggaagagatcaaaacagcgctccccctctggcgaatctcctcgatttcccgtcgcagacgaaaaactgcttccgggtcaaggccattggtcggctcgtccagaattaccagtttgggttgatccacaatcgctattgccagattcagtcgcattttcattcccatggaataagttccggtgcgatccaaaagtctgtcccccagatctgtgaaaacggcaagttcctccacccgctctttgggtacctttctggctgttgctgccatccgcaaattctgtataccacttaattccggataaagagcggggacttccatggcaattccaatctgttttaatgcttctaagcggttgcttttgatgtcattcccacagattctgattctccctctatctgtcctgtataatccactgatgcattttattgtagtcgattttccgctcccatttggtcctaaaagtcctacaatctcccgttcgcccacggaaaaacttaatcccttcagaatcttttttcttttcttagacttttcaatatcctcaacctgtaaaaccttcattccgctctcccctatattctgtcttttttcccggatacagtacacgttattatcataatcaaaatacagctgaatgttagttccaataccgcatatagccatgtgatcctttctgatcccagcgtcacattccagcaggatccaatcgcaaacggattatatggttttccccagcctgtcaactgactgtatcctgtaagtacggttgctgctgccaccacgaaagttccgccctgtgaatgctgtatcagcactcgaatcccgcttccaagcattgcaaaaaacaaaacttttaatactgcaagtatacacatatatagcaagaaacgatataacggaagtgatcccaacggataagttgtatacaacatgactcctcttcctccgtctgtatacttataatccgcatacatgcgggctagcccctcataggagtaatcttccaaatgctcgtatgaataaaaccccttataggttttagcatccacaaacatatggctgtcaatcccattaaagccgtatcgcattccccaatacaaaaaccacacacctattccaatcacacacacaactcctgccgccaggaaaaaggatgtcacataatgcctgtatttcttccactcactgcatggctgcactgtcataaattcatacctgtggtcattttttccctccataatgtagccaaaggaaaataacaggatgcaaatatctaatattgtaggtacatacgcattttcacaaaatagaatctccaaaaaagcatagggcgatcccgaatccaatcccagactttttttatcataatcatttaataaatgttccagacggctcatattattctcatacgctgcaacagaagcttccatcagttcggatgatacatatggattcgcagtcatagaagaaatgtcaaacggaaggtcataaagtcccagctgcctgccccatttctgaaacatatctgcacaacgtacttcaacagggctgcatccacgctctggataaacaaacatctggtatgatacaatactgcatatcaccccatatgccttatattccttctggaactgctgtgactctgtcccacccacctcaagcaatgcaataagttcctgtaattcttctattctccatttacgaaattgtattgcatttgtattaaattttcgccgttctgcatctcctgcatctctgcgcgcagtagcaagctccgattctaacagctgccgatgcatcacaagttcatattgcagttcccgctttatatagttcgtgtcctgactggatgtaatcgatctttgcagttccaccgtagcttttaatccaaaaagcagaacaaccaacagaaaaatataggctgccttatttctaagaatcgatactatctcatatttcaacatacttttctccgtctttatcataaaggtaaggtgtgctgccacaccttacctttatgatacttgaagtttctcacatttttaatttcataaatggaaacttttccgacatttatgcaggtttttcaaaaccttgcattttccctatgtccgttttatactgtttgtagtttcatataaaggagctattttctatgagtgtacaacatgccggttctattattagacaggcccgccttaatgcgggtctaacccaggaacaattatccgatggagtctgttctaccctctctctgtcccgcattgagaacggctctgccggtgtcagccctgccacttttcagactttaatggcacatgctggtatcttttgtgaagcttatcctactttctcgacgcgcgcagactttgactgcttttacgccttgaaggaagtacgcttttatctggattcctggcaactcacgcccgcctgccagttattggatcacattgaaatgctgaattgggcagacaataaattttactatcaggaatggcttctgcttcactgcaagctgcaattacgttctggtcatgcaaatcacgcccatacttatgagctggttcgctttgctttaaaaatcacaagatctgatatcgacaatgcagcgatccattctctgtttttgtcttctgtcgaaatagaactatttatatatcttgcgcaggaagcactgtacattggtgatacagctactgctcatcatgtctgccagcagatttcttcctatctctctgcccgttcgctttcttttcttgaacgggatcgtttacttgcggaaaatgcggtggtatataccaaatatctgctgactgtctgtgattataagtctgcacttgaactgtcgaacttctaccgccatcaaatgatttcaaatcttgacgacgggcttatgcatgagctgacgtttttaaccgcactcggatgctactatacgggacaacaggatcgttttctgaccttatttaaaactgcctttttctctgcccattccattaacagctgttatgccaccatctgtaaaaattatgtttccaaccacctttctaccactttggctgaagacttaaacatattttccgatattccgcttatatcgttttcccccaaggttcctagggatgtctcttctatgggagatggcacctatgactttttttctcacaaggttttcacgctgggtggcctgatccgctctctacgcaaagagcaaaaattatctcaaccggcgctttgtcggggattatgcagcaaatccaagctttcaaaaatcgaaaacgaaacacagcagcctgatatcattcttgctcagactttgctccagcgcctaggtatttcggatcttgtttttacattttacgggagtgaaaaagagaacaaactgcaggaactgcagtttcgtttagcaaaaactcgtatgaaccataaaaccttacagcttgatcttgtaaaaaaaatggagatgctatgcacctccaaagatatctgctatttacaatttgctgcttacaaatcagccatctgcgaacccgacaataatcaaaaattaaaggggttaaaaaatgctctttttatgactttgcccggctttcaatttgatgaaattcttgactatcgattatcgtggatagaacttaccattttaaacaatatctgccgcacttatgcaactataaatcctacacatggcatttactgtttttataagcttctggaatataccagccatgttccgttggatgttctcgagaaaaagcgttccttccccgtaaccttgggaatgcttataagatttctttatacagaaaatcgtctttcggaaatcgttgcgttagtcccgcttttttccgatgctataagttcaatgtattttacagggaacattttttcacactactgtcaggcattaggatcacttggtctcacaaattccgcaaaggaatttgcacactatgcctattacaatgccctccttatggaggacatctacaatgcatccggtctgaaaaatgatctgaaaaaaaattacaatatttctttactataaaatttcaatattctcttctgaagaccagtagggtacaatctccttgctgcttactccaaccatggtaagcagcaagcatgccattactatggtagcaattactttttttaaattatttcccttcatttcacattctccttcgtccacttactatgtaaaaatccacacagtatatcaaatccacccgtttctcatactatataatgtgcagaatctttcattctctttcacgcttgtattcgcctttgaaatatatagtatcttacatatatagtatctcttttctacaaaaaataaaataacaaaagtggaaacatttttgtttccactttcgtaaaatcacttcaaatatttctcccacagatcgctgtccgtccggtacggttccagttcctccatcgtccactgcgtggaatcccagccgtgcataatcagtccttcatcgtaataatgataggtaagattcacataaatatcatttttgcagaggacatagttgctgtaatatctcccgtccagaatctccccgtccatcgtctgtcccgccatctgggcggtaaatgcgggcgcatcgttgaaagaatccgacttctcacagattttttcataataaacctccgcaaatgtatcatccgaacgcagtacgtcctcaacctcatatcgctctgccgtggcaagattgatgactcttgtgcgcaggtcacaaaactcgccccacatacttccgttaaaatagtgatcctgaaatgccacgcacagaatctcatcactcatatacgtgatctcataatccacataacatgccagatacgggtagtcttcatccagatacagatattcttcctgcggttccggatacatggtatccagctgcgcacaggcggcattccgcagaatctcatttactccggtcgcatctcttccatccgcataggtaataaccggatacgaaacatcgtactcctcaaatccgtctttccgctgattcgggacctcgatatgctgtgcggtaaccgtataggaaagttgatctgccacataaatgtcatcctgcgtgacaaaaaagtcttttcccagagaatccgccagttctaatacctcacgttcctccccggtgtcttctacctccgtatcgtcctccgtatagctgccatctgccccgtctctgtacgcctccgcagacgactcattccacgtcaacgtatcctgcacggtacggttgaccgcgtgaaaaaggatgaacgaaggcacggtcacaagcagcacggcacaacctatgatcgccagcacaacccacagcagagcacggctctttttttgaggtgctgtctgctgaccgtaactctctccgtacccctgtccatatcctgtgttctgataggactgctgaccgtaactctgtccgtagcccatattctgattctgctgctggccgtagccctgtccataccctgtgttctgatattgctgctgaccatagtcctgtccgtagcctgtgttctgattccggtacgcctgcggctccggcgtaggctgctgctctgtcgcaaacgactgctccggcgtaggctgctgccctgccgcaaacggctgctgccccggcgcggtctgctgccctgccgcaaacgactgctgccccggcgcggtctgctgtcctgtcacagacgactgctccggcgcacccgctgtcgctgtatactgcatccacttctccggaatctttatctcttctcttgcaatactgcgcccgacagtcgcaaactcctccatctcgcgcagcacttccgcttccagtccccgatgctggaaattcagccctgcgtagagaagcgtgaccgcacccgccgcatcgatcgcaccgacggcgcacatctggtcattgtcatcaaacgctccaaataaaaagagcttatttttacatgattccacccatagatggtcttcatctgcatagcgtttgaaatcctctatctcttttggattcgccacatacggctgctccatcctgctgtatgtctccatcaccagcgctgccgccggtcggagttcatacgcatacaactgtctgattttcatttttaccaccactcctcattttcttctttctcttttatactatcatacctggcagcttcccgccacgacttttctcacctgtttctgacacgcaccggcgcactcaaacggtatgtaaaaagaatctcgcttgcgagattctccgcgcgcgagcggttcgcaaagcgatattttccttaccgcgagctgcgcatcctcgcggagcgttttttatttcataggaatgttctgctttcacatattaatatatcacggtatttcctatgaaacaaaaaaatcccctctccgccggcaatccggcaaagaagggatctgtcctaacctgacttcttaattgcgttcatgtaagatggattacataatcttgcggaacagctcttttaaatcctccaccgatgcatccttcggattgcccggtgcgcaggcatccgcatgcgcggactctgcaaggaaatcaagatctgactctttgatagcttccagttttgacggaattcccacatcctcggagagctttctgactgctgcaacagcggctttccggtactcttcctgcgacatggcatccacaccttctacgcccatcgcccgtgcaatttcacggtacttctcgcctgtgcagtctgcattgtactccatcacaatcgggagcatcatcgcacatgccacaccgtgcggcgtatcataaaccgcacctaatgtatgtgccatggagtgggcaattccaagaccgacattggaaaatcccatacctgcgatatactgtccgagtgccataccctcgcgtccttccggcgtgtttgccaccgcgccgcgcagagattttgaaataatctcgatggcctttaaatggaacatatctgtcatctcccatgccgccttcgtcgtgtaaccctcgatggcatgtgtcagcgcatccattccggtcgatgccgtcagccccttcggcatggaggacatcatttccggatctaccacagcaatgatcggcatatcatgcggatctacgcatacaaactttctctttctctcaacatccgtgataacatagttgatcgtaacctctgcagcggtacctgcggttgtcggcacagcaatgatcggcacacacggcttcctggtcggcgcaacgccctccaggcttctgacgtcctcaaattccggatttgcgatgataatgccgatcgcttttgccgtatccatagaagatccgccgccgattgcaataatatagtccgctccggattttttgaacgcagccacaccggtctgcacgttctcaatcgtaggatttgccttgatgttggaataaatctcgtaggaaagccctgcctgatccagcagatccgttacctttgtggatacctgaaacttaatcagatccgggtctgagcagacaaatgcctttttgtagtcgtgcgctttcgcctcattcacgatctccgcaatcgctcccgccccatgataggatgtctgattcaacataattctgtttgccattttttgttcccctttcccatacataatgatctttgatcgtattttaacaacacaatgtacaaaagggaagtgacagaatccgggaagtgtaactatttatcacaatttctatttcaaaatcctctattatcaatacaatatttctaattgttcaaacaactcgcttattttctcgggcatcgccttcaccataagttctgctaagcgctccggcggcatcttcgtcccctccgtcacccatttcactgtcatatacacggaactctggcagtacatctcgagtaaaaatccaatctcctcatcaggcattttccctgttttctgtcggatcagatcctcgtaaaacgccagaatcagcctgaaatcatgatctttgagattattctgatccgcagacttaaaaccggcggaaaaaaagacccgctcttcccgaatgtagataaattttttcacgagactctcataaatatttttcccgctccccatatgttcaaaagacttgtgaagtaaaatatcaaaataccagttgatcagatcgtacttgtcaataaaattgcgataaaatgtctgccttgtaacaccgcacaattccgtcagctgtgtcacggtaatgttatcgaccggtgtcgtcttcatgcattccttcatcgcctccgccagacggtattttgtgcgggttccctttgtcgtcgtatccaccttccgtctccttccgcttcgcgtcctgcgcttctttgtccggttaaatgcctgctcttttgctacagttcctgtccatcgtccgtttccgtattttcgtcccccaccggatcaggcatctcatatccgcccgtgattccctcctgtgtgatatgatatacggtaattcccgtcactaccgccactgcgaaggcgatggttaccgcagtaagccaaagcaccacccgggcgcttaccttctttttcggataagtgatctccggctttgtgcgccgcggctgcgccaccggcacaccaccgccctgcgcggatgtactgccgcttcccccgatatttcccatgtatccctgggtcatcggaaccgaccagattcttctctccaacggcacgtacattcccgccggtgccccctgaatcagcgtaaatcccgtgtggtaaaaataattcgctgctgacggcgcagcctgcaccgtcactcgcccgcactgcaatcgggatgccgcaaagttgcacatccggtccaccagattgctgccgatccgtcttctaaaatactgcggtcttacatacagcgctgtgatatgtccgacattctgcatggcactgacgccgcacatctgcccgttttcaaatgcgccccataaaaacagccttcccgccagcatctcctgtgaaagattgggcagattcatatagtcataatactgctgcacctccgccgcatttcttgtatacggacgcacacactgctcatagacctcatgcgccgtctgcaccgcccactgtatctcatttccgtataataatcgaatctccatctgtatctgctcctctttcacaatgcccgatccatagaactcttccatcacattttaactcattctaccatgaatctgaaaattcaacaatatccgggataccggcagctgcacaggaagcaccgcatcctctggagtgaaaaaccgcgcgagtccgtttccggctctgcgcggtttcgtttcatcctatagtatatggtaagcttgcttctaacgcgtctactattcctcttcttcctccggctcgtcttttgcccagccgtacgcatacttgactgccttattccagcccttgcgttttgccttgcgctcttcctcctccatctccggggtaaagatgcggtcgatcttctggttgttgaccacgtcctccttatccttccagtatccgactgccagacctgccagataagcggctcccattgcagtcgtctcgacgcactgcggacgcttcaccggcgcattgatcatatccgcctgaaactgcatcaggaaattattcgcacttgcaccgccgtcgactttcagggactttaaatcaatgccggcatctgcacgcatcgcatcgatgacgtcgcacacctgcagtgcaatcgattcgagcgtcgcgcggataatgtggttcttgttcgttcctctcgtcaatcccacgatcgtgcctctcgcatactgatcccagtgcggcgcaccgagtcccgtaaacgccggaaccacatagcagccgtgtgttccgtgaaccttcttcgccatatattccgaatccatggaagaatcaatcatcttcatgttgtcgcgcagccactgaatcgcagcgcccgccacaaagatggaaccttccaatgcgtaattcacctttccgtcgagtccccacgcaatcgtagtgaccaggccattcttggaaaataccggcttctctccggtattcattaagaggaaacatccggtaccgtaggtattcttcgcctcgccctcgtggaaacaggtctgtccgaaaagcgccgcctgctgatcgcctgcagctcccgcaatcgggatcgcatctcctaaaaacgaaggatctgtgtagccgtagacttcgctggacggacgcggtgtcggcagcatgcactccggaatctccagctcctccaggatctccttgtcccagcacagatcgttgatgttgaacagcatcgtacgggatgcgttggaataatcggtcacatgcaccgcacccttggtgaacttccagatcagccaggtctccaccgttccgaacagcagcttgccctgctctgcaagctctctcgcaccctcaacattatcgagaatccacttgatcttcgtcgcggaaaaatacgcgtcaatgatcagtcccgtcttctgacggtatgtctcctcgagacccttcgccttcaatgcatccgcaatgtccgaagttctgcggcactgccacacgatcgcattatagaccggttctccagtctccttgttccagacaatcgccgtctcacgctgattggtgataccgatcgccgcaatatccgccgccgtcgcgcggatcatgttcatcgcctcaaccgccacgccaagcattgtagaccagatctcattggcatcgtgctccacccagcccggattcggaaaaaactgccggaactctttctgtgccatcgaacagatctctccctgctcgttaaataaaatacaacggttgctcgtcgttcctgcatccagtgccatcacatactttgccataccatgttcctccttgtttgccccttattgcttatttatgcttccctctattgtgaaatccgttcctgccccgtgctccccatgcgcagcgcataaaaaaaggagacatcgtcataaaacctgtaagcacccctcatgtgcacaggaattaaaatcatctccactctcagatcccacaatatctaattatattttacaagagctgtgcgtttccactgcttcatgtataggcatattataccataccgcaatgaaaacgcaagctttttttgacacatttactataaatctacaaaatcttgctgaatgccagcaccacaaacagggcgccgccgatccaggagtaatctcttttgcaccggtccgccgcatatttcccgacagcgcttccgccaagcaccgcaagtgcactgaataccagattcaggcataccgtgccggcaatcgaaatatccagaaacgccgcccccagaccgccgaaaaatccgtccaccgacatggcgagcgcgaaacatattccttccgtcactgacatggtcgcagagcaatccctatctgccgccgccggattattgtaaatgctgatgataaaattcagctgtgaaaatttcatttttacctgcttgcacaggaaatggtgtctcctgatatacgcccggattccgtactccgtcagcttataagcgccgaccagaaacaatcccgcaaaacacagatacgccgcatatttttccctgaccactccatcgatcagttttccgcacactaatgaaaaaaacagcactccgctgcataccgcgccgatgcagagtgctgtcttcttttcgatccggatctgttccgccccgcacgccacggatgccagaaagacgtccatagagagcgctacgatcaataaaactgtctgcacatttttcctcgaaacggctttctcattctatcttattcaaatccgcggctgctgccactttgtattccggatcaccgttccgcggctgctgccactttgtattccggatcaccctttcaccgcgcccgcagccatgccgttcaccatgtccttgaccaggaaaaaataaagcaggacaatcggcaccgcgatgaacacgcttcccgccgcaaatcttgcaaattccgtctcatcgaggctcatcagaccgaccgccaccgtatacaggttcttttccttcagcaaaagcttcggcagaataaagtcgctccacggccaggtaaaagaagagagcgcagtataaacgatgatcggccgggagagcggcagattgattttcataaaaacctgaaaattcgtggctccgtcaattctcgccgcctcgtcgatcgccttgggaatcgtatcgaaaaagcctttctgcgtcagatagcccatcggcgctcccgcactgtagattaagatcagtccccagagatgattgatcagattaaactgcgtcatcagaaggtacaccgcaatcattcccataaaggaaggaaacattccgagcaccatcgtaatcttcatcatcggtttgcgcgccgcgaacgtaaaacgtgacatggtataggcggtcagaatcaccagaaacgtgccgaggatgcagctgcctgccgccacaaaaagtgtattggcaaaccagcgcggatagttgtacagtgccgtatccgtaaacagccgtttgaagctcaccagactgtatccggccgggaaaaaaccgtcaaacgaatagatcgttcccgatttggaaaacgatgcaaggatcagccacaggcacggaaagaagaatacaaacgccactgcaagcaatatgagataggtcattccggtatcgaggattcttcctgcggacatccgccgctttttctctgtttttctgctcattgaaacgtatcctcctccctgtaagacggtgactttatgtaaaccacaagtgatattgccgatgtgataaagaaaataatcagactgatcgccgcgccgatgcagtaataattgttgtcgatggacaggttatagagccagttaatcagaagatccgtatcgctcgcaaggaaatagccgtccatatacagcccgccccgcaggaagtaaaagatcccgaaattattgaaatttccgataaactgtccgatcagcaccggcattgtcgaaaaaagcacgaacggcagcgtcagtttccggaactgctgcatgcgtcccgccccgtcaatgcgcgccgcttcatataaggaagcatcccggtttgacaggattcctgtggcgagcagcatgatctgcggtgtactgatccagcagttgaccaaaagtccgatcaggcgcgccgtccacttggcatcgagatccagaaagccaaccgcactgcccccgtgcgccacaatgatctgattgaccggtccgccgtaagaaaacatgaacttaaacgccagcagggtgataaatcccggaattgcgtatgccagcaccggaaatgcgcgccagatggcttttcccctgacgcagtctttattcaggagcagcgccagcccgagaccggcaaaataattgagtgcagtggagacaagcgcccacacgacattccatcccagaatcttaaaaaaggtctgtgcaaactgcgtcagcgtcagcagttttttaaaatttgcaagtcccacccagtccacgagttccgggggtacaatgtctccgccatagttcgtaaatgcaatcaggatcatgaacagaaccggcaggatctgaaagatgaatacaccgatgaccggcagcgcgagcaccgtgacatagaactttttgtcgagcagctgtgccgcctcctcgcggaaggacaacacgcttcttccctgctcgatccgcttctgcatccggtaggtgtcgcgcacgtttccacagtagatacacacaaacgccgccagaacgatccacgcaaatattcccatcagcagcatgacaaccgagttatctccctctacgccaagccatgcatcccctctggtcgtacccagtgtaaaaaaaccggcgagatcacgacacccgcgcattgccatatagcagatcatcaggacttccgccaggaaaaagcacacgccttttccctttgcgccatagcggaactgccctgcccccatgatgaccattgataattttacgttcccgctgctgtcaccaaaccaggcagcagcacgctttattttttgcttcataccgttctctccatatctgctactttaacgtatatattgcgtcatggatctgtgtatccacctgttccagcccgctctttagcgcaggcagatcctgatactttttcccactgccgcttcggaacgcgtccttcgctaaatctgtaaaaaaggtctgtgccggcgtccagatctgcgacacctcggagatggacggcatcagcaccacatttccgttctcgagatttgcatagattttctccgatatgtcccccgcactctccgccgcatcgccgcgcgccggtgcaattccgagcatctcgctccgtctggtgaccatctcatagcttgtcgcaaaatcaataaatgccaggcaggcattcggcgccttggtgtacgcgctcactgcgtatccgttgactccgcccatcgctttcatatcgatcagtaccggatcgctctccgacagatcgccgctttccggaagcttcggcagtgtcgtcatgatcagattctgctttgctgtctccctggcttcctcctcgttcatgccctccgcctcgtattctttttccagttcatctgcgaacgtggagtacatatccggtgtcgagagcgtcgcaaaataggtgccatcccccagtttgctgtatgcgttggttgtgatcgtgtcgtcgatacattcctcgttcatcacacccgcaagctgctgcagaacccacgcgcctttttccgcctcgccggcagaaaatccgacgtcctccgggttcgtattctcctcgccgaacacatagccgccgtaggaaaataagaatccgctggaaaaatacacatcgtacagcgacttcatatacccgtactgcgccggattttcttcatggcgttctttggaatatgcatacagatcgttccagttctccaccatatccggcacgccgttctgatcctcatcccagttctcctgccagtcctccggcagcagatccgcccgatagtacagcatcggcgcctgcacattgaccgggacaccgcagcagtaggtcgtgctgtccacggtcgtctcatatgccttccacgcgctctccggaatctgctcatagcaggacagctgctgtaccggaagcggatagatatgttttcccttggcgtactgcatgatgacatcgttcgcctggtataacacatccggtccatagccataaggtccgtcatttgccagatccaggtactgatccatgttggcatccaccgccgtgattccctgatcggcgtacgcctcattgaatgcggtaatcagctcctcaaaatatcccttggaaatggcggtgtcattttccaatacccggatcgtgacattctcctccagttcaccgtcaaaaacactgcttccggataccgcggcagcgctgccgctctccgtcgtcttctcccccgtcgtcttctcatccgcacatcctgctgccgcaaggacggctgtcagaagtaacagtgccacctctttttttcgtttcatctgcttcctcttttctgcggaatttccgcccatatcaatccaacgcttccctctgctctctcacaatcagatacccttccggctccacgcagacgccgcaggtcattttcccatcaccagctgccggaagaaccgatgcccggtgagcagaaagcaccttgctgtccgctttcaggcaatgctcctgccgcctctgctcctccgtcatattgatgtacagcgatacgccctcgcccccggccttccgcctgacacagagcatcccgttttccgctgcaagctccacatttccgtcggtgatcgcggtgcagctgcggatatgcgtcagctccgtcagcttctttcgcacgtcggtatcggtgtgcaccttttcccagtcaaagcatctgcgggaatccggatcatagccgcccggcacgtttttgtgtcatagaaacgaagtttgctatgacacaaaaaaatccaccttcctaccctaaataggaagatggatttttcttacatctgcagcagatattcgatcagtttatgtccttccggaataaagttggctgtctgcgccgcctcgcgctcattgtaatgccagttctcactgcgctctgccgtgctgtcatagagcagatacggtacattgtccgccgtgtgtgtgcgcagggaaatcggtgtcggatgatccggaagcaccaccatgcggaaatcctctcctgcctccgcaagtccctcggcgatcggccggataatgcgctcatccaggcgctcgatcgcctttaccttcttctcaacgctgccctggtgtcccatctcatccggtccttccagatgcacgtagacaaagtcatatccgtccttcgtcaggacatctaacgccgcgttcgcttttccctcataatttgtatccagaccgccgttcgcaccgtccactgtgatgactttcatggaagtgccgaccgcaattcccttcagaagatcaactgcagaaatcatcgcgccctgtttgtgggtgcgctccgtaaacggatagagtgccggctttgtgcctgcgccccagaaccagcaggagttcgcaggatttaatccctttttcttacgctcgatgttgatcggatgattcacgagaatgtcatagcttttcttcatcatggtgcgaagcgcttcgttctccggaagcttgtctccgatcttctgtcccagcacatcgtgcggctgcaccagatccaccacctcgccgttctcccagatcagacagtggcggtagcttgtgcccacataaaaatgaaaaatgtctgtctccagttccttcttcaccgcctccaagagcactgcacattcctcggtactgatctcacccgaactgtggtcgatgatcgtacggtcctcgtaattgtcctcctcggaaagcgtgacgatgttgcagcgcagagccacatccgtgtctttcattggaacaccgatagagagtgcctcaagcggagaacgccccgaataaaattctctcgggttgtatcccagcacggagagattggcagtgtcgctgcccggcttcatgccgtccgggatcgtatgtaccatgccgatctcacctttcgctgccagttcatccatctttggtgtctttgcatactctaacggagtcctgccgcccagactctcgatcgggcggtctgccatgccatctccaagaattaccaaatacttcatctcacacttcactttctgctgttatcagcctgctgtttcacatcggatccctgttttactgtgccacgcggatcatctgaagtacactgccaagctccgccgcctttttctcataatcagcttcgctcatgcgcgccgtcacaaatccggtctctccggatacgccttccgccgttacataactcacttcaccgaagacttcttctatgcgcttctcatctgcggacgtgcgcacaaaatagcagttctcgacgttgcggtaatccaccagttccagtttcttagagctccactccaccgcgatattggtgtccagatgcttcgccatatccacgatatccgctacaaccgcgctcgccgtcgggagcttgccggcgccgcttccgtaaaacatggcatcgccgagcacattgccgtgtacaaagatggcattgaacacatcgttgacattgtagagagggtgtgtcgccggtaaaaggaacggcgctaccatcgccacatatccgtctcccaccttgtggctggatgccaaaagcttgatggctctgcccattgtcttcgcataccggatatcggtcgctgtgatcttcgtaataccctctgtgtgaatatcctcaaagtccacctgctgtccgcataccagggatgtcaggatggcgatcttgcggcaggcatcgtatccttcaatgtcagcggtcgggtctttctccgcataacccttcgcctgcgcatcctttaacacatcgtcgaactccgatccctcctcggtcattttcgtcagcatgtagttcgtggttccgttcacaattccggtgatctcctcgatctcatctgccgtcagacaggaattgagcggccggataatcgggataccgccgccgacgctcgcctcgaacatgaaattgacatttttcttcttggcgagtgcaatcagctccgcaccctttgccgcaacgagcgccttgttggaggtcgtcacatgttttcccgcggtaagcattgcctttacgaacgtgtacgccggctccacaccgcccatcgtctcgacgacgatctgcacttccgggtcatttgcgatcaccttataatcatgtaccaccttttcctgaatcggatcccccggaaaatctcttaagtccagaatatatttcacaccaatctcttctccggcacgctttgcaatgctgttcttattgatgtctaatacttccactacgccggaaccgatggttccatatcccattactgctactctgatcatactgcctccactttcgtcttctatcctattctgttcctactctcttccgaggatcttcacataatgtatccctgtctgctcctcgatgctcgccaccatctgtgtcacatctcccgtctccggcagaacatcgaccgagagtgtcagcgatgcgatcccgttgatcggaatactctgatgaatcgtcaggatattggcgtgaaactctgccaccgtcttgagcacaatcgacagcagtcccggttcatcatccagctggatgaccatggtgatcgtcttcccctttgctgtctcatgaaacggaaaaatatcatccttgtatttatagaaagaactccggctgatcccgacctgctctgtcgcatcctgcacggagtccgtcttccccgaatccagcagccgctttgcctccacgacacgaagcagtacatccggcaccgccttttcctttaatacataatactgacctttctctttcatgttcctcataatcctctttcttctggtatccctcacgagtgtatgtgtgcagcacgctgacacttgtcctcatgaggaagataataacacaaagaggctgcacaggcaacctcttttgtgaatatccgtaataaaatttagttatggaagctattctccctttaaaacttgcggcttcctccgccgtgtgatctgccgctgctgctcgtgtgcgtcgtgcttcttccgctgtgcgaggaggaatgtcctccactgctgccgctgctcgttgagatcctgtgatgcgtcgtcgtctgattcaccagacgatcttccttgacgcgcagattgaccttggaattctgctggtaagcgtaataatatccctttccgcgcaccttgtaactgttgctgatcgtaaaataaatgatgcagccggctccgatggcgaccgccagcacgccgaagatctccccaagcgtcagaacatggtatctggaaatcttccccgtctcggagtcataattgtactgtccctctgaaatccctttttcatagtaattctccacaccggtcagcatggaatgcatacagccattgtaatcgccattgctgatcttcgcgtacgcggcatccaggatatcgtcaattctcgaatccgtcaaataacggatcgcgataccgcaggtggagatcgtgatctcgcggttatccatatcaatcagtaatgccacaccgtcttcctgttccggcgaatgttcgtcaaagaaatcatccgcgtatgcggtcgcacttttcccctgtgcatcatctgtcgtgaccgcatagacattccagccggattcttccataaacgaggcgatctcatcgtttaagtccgcgatctcatctgccataagaagtcccgcctcatcgtacacataaccatccgctgcatcctgcgccgcgtccgcctccgccgccagtgccgcaccgctgcacggaacaagacacaccaggcataccagacaccacaggagcgattttttcatcttctctaccataagaaataccctcctaacagtccgaataccagaatgccaagcgctatcaacagactggtgagcgcaagtctcgggcggtcaaccggcagatcaccgcagatatttccattctgtccgttcatggaatagtagtatacttttccgtctctgcccttatatgtaatcgtccataccgggagcagcacatacgaccagatttccttcttcggtgcaaaaaacgtattcttgaccgatacgctgttgtaaccgctgatggtatcgcgcatcagcttttcagcgctctcacgcatggtgtgctgcatcttgccctgcacagcattctgctcaatatctctgcgctccgcaaggaatccggagaggtatcccatgtgaaaatctttcatcttgtcataggcgtacggcatcacaccgctggtaagctttacattcgccttcttcaacgcgttctccgtcagattgcgaagcgacacattgccctcgcgctccaccgcataatatttggtctccgtgtactgggtattgcccgtcgtccacatgcgcacacttctcgcgtctccctgcatctttccctccagctccacgtcgtagacccagtatgggaaataaacgcctgtcatgctctcaatctgttttttgttaaaaaatgccttcggcacatatttctttttgctgacaaaatccagaaacttcttctctgcatcctctctgccgatctcaaacggaatgatcttattcggcagatagctgccttccagccgttttccgagcacgaccggattatggcagtaatagcagaaggttgccgcagtcgtcgcatccgtcacaatctctgcgccgcaggacggacagctgtaatacaccgcctcgccctccggttcgctttcccgctctcccactgtctgcccggtctctgccttctcacctgccgctgccccggctgccgcttgtgctgcccgctcctgtgcggcagcttccggctcctcaccctgcatcggcttcatcgcatcgagttcttcctgtgtgaacagcgaattacagtattcacacttatacttctgtgtcgccgggtcaaaaatcagttctccgccacagtttggacacttaaaactgataattgccatcgctagttcctcgctttcccacagttgctgcagaattttccggtgttcgtctgtccgcactcgcacgtccactcaccggataccggctttggttttccacactcgctgcagaactttccggtgttcacatggccgcactcacacgtccattcgtcagataccggcatcggttttccgcactcgctgcagaactttccggtgttcacatgaccgcactcacatgtccagcccgcctgagtacctgcccccggtgtctgtcctgccggcactgcgcctgccgctggcatctgtcctgccggtgccgcgctgccctgctgcattcctgcatttgcctgcatgtctgccggtgtctgcatcgcgccaagtccggacagcgtctggttcatggcattcattcccatgccaactcccataaagcctgccatggcaccgttcgcattgcttccggcgtcacgcacaccctccgtaatattcttgaccgccataccgcgcatgacgttgaaatcgcttccgagcattgcgccctcattgcgcatgttgatcagcttctgggactcttcgtcataggaaatgcccgcgataccgaccttctggatctccataccgcgcatctggttccaatcagcatccagaatgtcctgcatgtacttgcccagttccatcgccttggaagtcacataggaaatacgtgttccgtccgccgacatctggttgatcgccgactgcagtgcctctaaaaactctgacaggtactgctcgccgatctcatcgtaattgacacggtctttgtttctcgggatcacttccgcatagaactgcagcggattcgtgatcttgatggaataattaccgtgtgcgcgcaggaaaagctctgcgttataaaaattatcaaagtaattgatcgggtttctcgttccaaacttgatccctttgatctcctgcagattcaggaaatatactttctgtgccgtcggcgtctgtccaccgtacttgatacggttgaacgtctcttttactgattctcccagttcaccgtttagcatggacggcagggaagaattatctaccttataatatcccggttctgccgtgtaatcgactacttttcctccatccacaagcatcataaactggttgtcgtacacgtgaatcacggagccattgctcaccgtattgttcgtccccttggtattctgtcctctccggatcagcacaccactcgtaaagacggtctgttcccccatatcatccgcctcgaacacctcgagccactgatccgccagtcctccgctgatcgcactaccgattgccttgataattcccataacaattcctcctgttctattctttcgttgtactctgacgagttcttattggaagttcctgcaaaacttcatatgcacagaatcatgcgccaaaaatgtattcacacatggtgataatccacctcagaaaaacgtaccatccgccagactctggtgtctaccggtacaaccgggctgccgcagtattcacagatctgctgtccaagtcccttcatcggagccccgcagttcgggcagttcagcccgaaggcatttccctccgtctgctgcgccgcatcctgtacatagagcagctccatattgtactttgtctgcagcttccggtctttgtatccccagataattttgcccgctttttccttgtagtggtaatgctctaccgcactctgaaatgtgatcacacaagtgccgttctttttttcgtaattggaaatctctgtctgatgaatgcggatctgctcataggtctcacgcactcctgccgcacggtttccctcaatctgacggctgacctgctccttcagttcatcggaagcgcgcgcgacactttccagattccccgccgacactgcctgaagcgccgccacaagctgctgctgtgcgagcgcctcaaactgctccagattcattcccggaaaatcacgggaaatctggggtgcaaaaatccgcgtcatggaagcgaccgacttcggtgtctcctccaacatctgttcctgacgcttatattcctcaatcagaccgccttttccaaacacccactttaaggtgcggatcacatcactgctcatcgtctcctccaagtcccttcgggcagccgagggagagccacttcagatatccattcataaagatatccagctttccgtccagcacgctgtccacattaccggtctccacaccggtgcggtgatccttcaccatcgtatacggctgcatgacataggagcggatctggttgccccacccgatctccgtcacttcgccgcggattcccgccgccttctcggcattctcctgctgctttaacaggtacagctttgcctttaacatctgcatcgctttgtccttgttctggaactgggaacgctcattctggcactgtaccacaataccggtcggaagatgcgtgatacggatcgcggaagacgtcttattgatatgctgtccgcccgcaccgctggagcggtacgtatcgatccgaagatcatcgtcattaatctccacatccagatcttcctcaatatccggcatgacatcgcaggacacaaaagaggtctgtctctttcccgctgcattgaacggtgagatacgcaccagacggtgcacacctttttctgatttcagatagccgtaggcattttctccatttacctggaatgtcacggacttgatgcctgcttcctctccgtccagggagtccagcacttccacgctgtatcccttgtcatctgcccaacgtgtatacatgcggtaaagcattgccgcccagtcacaggactccgtaccgcccgcgcccgcatgaagcgacacaatggcattgtccccatcgtactcgccggacagaagcgtctttgcgcggatggcatcgtacgtcgtcgtaaactccgttagcatttcttcgatctccgggatcagcgtggcgtcattctcctcatatcccatctcgatcagtgtctcaatatcttcaaactgtgtcgtcaaagaagcatatgtggcaacatcgtccttcatgctctttaactctttcatttttttctgggagacctccggatcattccagaaatccgcagcttccatctccctctctaactcctggatccgctgttctttgtttaccaggtcaaagtgaatccctcacttcctgcagcggttccctgtatgtgttcagggtcactttaaattgatcaagttctaccacagttatcacctctttcattttttctattcttattgtactggaagccccgtcttttcgcaatcttttcccacaattttcgcagcgctgtaaaaagcagcagccagatcaccgctcccagcgtatcaatacacacatccgggaaccgtccggcgcgccccgggacagacagctggtggatctcatcggtcgccgcgtaaagcgccgcgaccgcaaccgccgaaattccgcacactttccagttaccggaatatccgtgcacaaaagcgcacgccagcagacagagtattccatattctgtcatatgcgccagcttgcgcaccggataatcaatccggtcggcatatgcttccatctcgctctgtgtatattctgttcctgtcagatgactccatgtttccacaatgcggtaggcaaccccaccgctgacctgctccgattccgatgccggctgtgccgaaaaccggaaaatcatcaccatacaaagaagcagaagtcctcctgttatcacacggtatatccgaagcttcatcccgtctcctcactccgatcagtcgttctgtgtcttctcactcagcacttcgattgccttctgcacctgattatcgtattggatctcatactgctctccgtccgggtcgagatactcatattccagttcaatgtccggatcgattccgacaccgtggatatagttgccgttcggcgtaaaatatttcgcggttgtcagcttgatggcgtctccgtcttccaacgggaacaggctctgcacgatgcccttgccgaatgtcgtcgttccgatcagcgttccgtagttgtaatccttgatggctcctgcaaaaatctcggaagcgctggcgctgtcctgattgattaacaccgccatcggatagtcaaaatgcgtgtctccgctggagcggtactcctcgcggtgtccgttcttatcctccgtgtagacgatcagaccttccggcagaatatcgtcaagaatctgtaccacggaatcgacaagtccgccgccgttatagcgaaggtcgaccaccagcgatgtaagcccttccccttccagttccgcaagtgccttctcaaactggtttgccgtatccttctcaaaagattcaatccggatataaccgatcgtatcgtttaacatctgtgaagatacgctcggcagcgtcacatcggcacgctccacgtcaaacgagagattctctccggtagacgggcggtagatctcaagatgtaccgtcgtcccggcttccccgcggatcagcttcacgagatccgtgacatccatcgtatccgcctcggttccgtccaccgacagaattacgtcttcgttgcgaagtcccgcactctcggacggtgttccctcgtaaacctttgtgattgtgacctgcatggtatctttatcctgcgcaagccctgccccgattccgtaatactgacccgtcatgctgacctgcgtctgcgcgtactcatccgccgtgtagtaaaccgaatatctgtcatccagtccctccagcagtcccgcatacagaccgtcctttaaatcctgaacatcggtatcttcataataatacagatcaacgtaagctgacagttcgttgatctttgcggttgtctttgcatccagcagggtcgttccgtccgtatctgccgctgcattggtgatgagtatctggcttccggtaaagcggcaggtcagataaatgccaagcgctccgacgaccagtgttccgcagattccaagaaggatgccggctcccattccacggcgtctgcgctcttttccgccgtccggcttctgctctccggttgtctcattttctatcatgccgttttgcatattttctctttgttcgtccatagtttccctcatttctgtatgctatccgtaataagatatgtaaaaattccctgtccaaggacagggaatttcggtcaatgcctacgtgtactttctccatcagccgcccaggtaactccacgggctgacgtaacttccatttaaagagacgccgaaatgcagatggcttccggttgaaatgccggtacttccgacttttgcgatcacatctcccgccgacacggtctgtccgggcgataccagcagggatgatgcgtgcatgtagacggtgtagagtcctccgccgtggtcgatcatcacataattgcccgccgcactgctgtaggatgccgctgttaccgttccatccgccgccgcgataatgtccgctcccgccgatgctccgatatcaattcccttatggttcgacgacgctcccgacatcggggatactctcgttccataatcgctggtcacccgtgtgctgctcgggcacggccaccggaacgctcctccggtatacggatgttcctccaccccggctgccgctttctccgcttccgctctcttgatcgccgcaatcagttcttcctgcgcctgaatctccgccgcataatagtcggcgtcgctctgcgcatcttcaatatctcccgagatgtccgcaagctccgactccttctgccgcatcatagcggcaacagtcgctttattgctctcgaccgtcgacttgagtgcctccagatcagtatactcctgctccagctgggcttccagattcacaatcgactccacggtgtcctggtactcggtaagcttttgtctgtcatagctctgtatctgtgcgatataatctgcggaatttaaaaattcagaaatgtttctggaagataaaagcgcctccagataagaggtctgcccgttctcatacatgaactggatccgcactttcatatccgcgtactgctgtgcttccctctctttggctccggcaagctcgtccttcgtctcctggatatcctcgctctttgccgtcagctgattctcaagatccgtgatccgcgcggatatatctatcagctgctggttcaattctgttaccttgctctcgatatcacccttggaatccctgagatcctcaatcgtgctctgcgcctctttgagcgctttttccagctgggctttctcgtcctgcgcctcctgcagggattttgtggaagcggcgtcctccgtcactttctctgtggaagccgacgatgcctggatcggtatgcccgccgccagcaccagaatcagtccgagcgctgttattcttcgtatcattgtaaacttcatgtgtttcctgtatggcatcttatcattataccctcaaatgcttgcgaattgtgatgcggcttccgataaaaccgattcccacacccagaatcaatgccaccgggatcagattatggaaaatctcgttcacgctaaggaacttcatcatattgctgataaagctgaacttatcgctgatgtacattacaatcttcccgtacaatgcgtacagaatgccaagcggaattgccgctccgatcagtccgattacaataccttcgaccacaaacggtgcgcgcacaaaataatccgtcgctccgatcagcttcatgatcgcaatctcttccttgcggacggagatacccaccgtgatcgtattgctgatcaaaaagacggcaacaccgagcagaatcaggatgacgcccgccgagatgtacccgatcagactgttaaagtcggtcagcgtgttggccacctgctgggactgctttacttcacgcactccatcgacggacttcaggtaggtaaccagcgagtcctgcatcgatatatcattcatgtagatggcatagctcgcggaattcgccagcgggttatcgccagcaaaacttgcagccgccgcttcatttccctcaaagtacacttccttgaagctttcccatgcttcatctgctgagataaagtcataatgtgatacttccggtctctccgaaatcagctccccgatctcctcgatccgctgatccgagattccctcatcaaacagcaccgtcactgccacgccggactccgcatcctttaccatggactggaagttcacgacaatcatatagaacagaccgaacaggaaaatgcatgccgtcatcgtggcaatcgacgccagtgagaacagcttgttcttccagatattcacgattccctgcttaattgtataaaaaaacgtactaattcgcatagtcgtcgtcacctccatcatccaagaaatcatcaaacagatcatcgtcctgttcgacagaggtatccttaccgtaatgatccgaagcggtatcgtctaccacaacgcctttttgcatcgtgatgacacgcttattcattgctttcacaatctccagattgtgtgttactacaaccaccgttgttccctgctcgttgatctcctccatcagcttcataatctcccatgcattattcgcatcgagattaccggtaggctcgtccgccagcagaatcttcggcttgttaatcagcgcgcgcgcaatcgccacacgctgctgctcccctccggaaagctgtctcgggtatgagcggtattttgccgccagtcccaccatcgacaacagttttggaacatttttcttgatggagcggttggattcgccaatgaccttttgtgcaaaagctacattgtcataaatatttctatcctttaacaatcggaaatcctgaaaaaccaccccaatgttgcggcggaatttcgggatttgtcttcgtctgattttatttaattttctgccattgattgtaatggttccctccgtcggttccagttccttcaacaggagcttgatcagcgtcgacttgcccgaaccgctgtcaccgacaacaaatacaaactctccctcctcaatgttaagactcacgtcattaagtgcaggaattcccgcagagtacgacttgctgacatgctctaactttatcatgaaattacctcatttctgtatgcatctccgatggttccggagaatcaaatgctctgtcccatcccatatagtctactcaatgtatgcagttgttgcaatacccgtatgcaaattttaagaattagtagtccagagactccatatacttcatatattttacgaccatcagtgcgatcttgaacgtgatggcatcctcgaacacacgcagatccagtccggtgctcttctgcagcttatccagacggtacactaacgtgttgcggtggatgtaaagctgtctggaagtctctgatacgttcaggctgttctcaaagaacttgttgatcgtcgtcaacgtctcctcatcgaaatcatccggggacttattgtcaaaaatctccttgatgaacatcttgcacagcggaatcggcagctggtagatcagacgaccgataccgagtgtggagtaagcgattacatccttctcctcgaagaagatcttgccgacatcaagtgccatccgcgcctccttgtaggatctggatacctctttgatctcgccgacaatcgttccgtatgccacatgaacgtcgctgtccgcatccgcacggaacaggttgaccatgctctccgcgatcttgttcagttcctcgtaaccttcgttctcgccgacttccttcacaacgataatattcttctcatcgactgctgtgacaaaatccttcgtcttcgtgccgaagattccgcggatcttctccagttcattgccgtccttgtcgcggttcgtctccacaatgaataccacgcggcgcacctcggtgtcgatgtgaagcttcttggcacggttataaatatcaaccagcaacaggttgtcgagcagcagattcttgataaaattatccttatcgaaccgctccttatatgctaccagaagattctggatctggaaactggcaatctttcccaccatgtatacatcatcgctgtctccgcttgccagaagaatatactcaagctggtgctcatcaaataccttgaaaaactgatatccgttcaccacctggctgtctgccggtgactccacgaacgcctgcgccggctcaatgtactgatccgcctccggaaaagtggctgctaacaccttcccctccacatcaataatgcacagatctattctggtgattccctttaatccatcgattgtattctgaagtatttgatttgaaatcataagctccgctccttctcatcctgcttctgctgaaactcttctgtccggtcactgtgtttcttccctatgagcaactttcacaataaaaagccgcctttctacctcggaacaaaaatatctaagctatattttaatgcaaaacagcaaaaaaagaaagaggaaatgcattttttttatgcatttcctctttttcactccgcttccccggacttttcctgatcctgatacttgttcatactgttcttcaatcttcccagatgcagccggttcttaacgaaacttccaagtccatgcttttttccatgaacgccgagttctcccatgccgaaccatatggtcgcgctcatcttatccttatgctccgcgaaaaaatgttcctgcagcggagacggcagaatcgaaacgatcacatccggcgtcgtcgcattcatctcattgatgacggcatccagattccccacacaattttccagtgcatattctcccgccagaatcagcttcgggaatgcttcctgcagttccgctttgaccttctgcacgtcctcctccgtctgtcccagcacaaaaatgctccgcttattgcgctcgatcctccgatagaattcatatgaaaaatcattctgctccgtctcctgcacacgctgcatgctgtccgcatccgccgcctttaagatctccttctccccaatgacggaaagatctagctccgagatcacgttgtgtaccaccgggtccgtctctgacgcaatcagcatctgcatggaaatgttttcgattgtatttaaaacatcattactcagatagttctcgacctgccgcatcgattcccgcacggtatagttgtcaagaccgatccccataatatctatttttttaatcattgtgcacctatatcattaccattatttgaaaaaacataccttcgtctgcgaaagatatgtttttagtatagcaaacttgtattcgtatttcaagattcttccattccggtcaaatttacagacttcttttactgcttttttataattattttatatttgaaatgtcaataacttttccaaactttccacgaaatcggacaactttattatttcttcacaaaacagacattcgattattttactatgtaaaccagatttttttcccacttttctgtggataatgtgaataacttcgtgtataactcgatttttcctgtttttccgtttctgcattgtggataacttttttgcaattcacactcatttagtcagttttcctttttcattttttacaatttgtgcacattgtatagactgtgccttttgtcctattccttcattttttgcaataatcctgcgttttggggtgcaatattgagaaaatcatgtcccttcgttatcaggcagaatgtaactgaaaatcaaaagagcttccgcttctcttcctcttcttatgacgcaaaaatgggactatcacaagtgatagtcccattttatattctcgtttagaaaattcttcttacacagatcgggctgcggtaggtaacactggagtaagtgataccgctggacggtgtgctggcatgcacgatcgttccatttccgatatagattccaacatgtccgctgtaacatacaatgtcacccggctgtgcagatgaaaggcttacttcataaccacagcctctcaacgcactggatgaatgcggaagaccaattccaaatgctgaatacacactcataacaaatccggaacagtccgttccattcgtaaggctgcttccgccatatacatacggattaccgacaaactgacatgcatagcttgcaactgcctgaccgtttgaactggtcggtgcactgtaggatgcactggaatctgaggagctggatgaactggatgaactctcagagttcttctttctggcgctagctgccgctgctgccgccgcctcacgctctgcctcttccttcgcaagacgtgcttcctcttctgctttggactccgcctgcacatactctgtcgtcaatgtgacataatcggtggatacatagccgtctccctcttctgtcgtcacaagtgcccagcccggaatggactcatcggttaccacaaggtcatcctcaatcggaaccatggttaaaaccgctgcatctgtggacggctctgtacgcacataaagcgttgtcgtcgtaacttttgcatagcgggtacttacagactttgcaagttcctcatctccggcaaccacgtactcacacttcacataaccggtaacattgccggatgtgatctcataccagccatcctctgtggtctgtaaaatcgttgccgctgaattattgtaaagcttaccgactacctcgctctctgtgttcggctcggtacgcacgtttacatagttatctacctgcgcaatggcaatgtctgcatattcggactctaccaccggcgtctcattctcgcttacctgttcctgctgcgctgctgcttcctgcgccacttcctcattgcttgcgaccagacaatctgccactgcaagcgaaacgcctgcgctcgggctgctgcttcccgttccgactgccactgcttctgctgtggtagcaacggacacacccgcaaccggtgctgcatatatcatagatacaggatctcctgccaataacattccagtcaatacaatccctgtagctctcagtgttcttctgttcatgaatgcctccaacggatttattacaaatttgttacatttattacatggttattataacaaagcgtctatatgatgtcaacccgctatattttgtaatactccgcagattttacacaatattttctttttcgacacgtcttttccacaatctgcgccattttccgacaaatccgggttacatatgctcccagattttcccttcctgctgctgccttatgcctttccggttttatagtttgttgcatttttcataattgccattctcctccatctgtggcataataaagccatcataagaaggaaaggtgggattcgtatggatttttccaatgttgatctggcgcttggcacactgatggcctacgactccggttcttctgtcagctccggcagtctcgcctatgcagtcggcacggccgttctcagtcagtcattagacctgacccagcagatgggagcctccatgattcagatgatggaacattcggtgaacccggagctcggcggcaatatcgatatgtacgtatagggatcatgtaacagatgctctctgaaaagaaaagacgcggcacacgatgtaacagtgtgccgcgtctttttatgttccggatctcctccggcagtctcaggtattcctgttcctgtcgcagcaattatttggtagcaatcgcttcgatctcgagcataacgtccttcggaagacgtgccacctcaacgcagcttctcgccgggtacgcgccctcaaaaaatgtcgcatatacttcgttgatcgctgcgaaatcattcatttccttaataaatacggttgtttttaccacgttcgccatgctggtgcctgctgcctcaagcagatgggacaggttcgtcagcgcctgctttgcctgcgccacagatccctccgggatctcgcctgttgccggtacaaccggaataataccggatgtgtataccatgccgtttacctcaatcgcctgggaatatggtccgatcgctgccggtgccttgtccgtgctgattacatttttcatgctgtattccttctttcttatagtctgtcggtttcatctatcatagcacacctgaaacagcgatgctactataatttgcggattgcgcgctccgtaatctcgatgcggcgctccttgtacagtctgccgaccgcacgcttgaatgcatttttgctcagccccgtctcacgcatgatgacttccggtgaagccttgtccgtaaacggaagcacgcccgcgaattcctcaatcacttccatgaccttctcggcgtccgcatccatctgcagatacgccttttcccgcatcgtgatgtcaagcttgccgtccggcttcaccccggtgaccttcgcctcaatcacatcgccgatctgaagatggctgcagtcctcatgtgccggtatcatcgccgagtagcaatcatccactgccacaaacgttccgaaatcatgaccgaactcgtagatccgtccgtttaccgtgtctccttttttataaggagaatccgtgcgcatcaggtcgtacagctttttcatgcttgcacagagtctgcggctcttatcgatgtagagcgtcaccagaacctcatcccccggctgcacctttttcgtcatctctttatatggaagaaacaggtctttttccagtccccagtccaggaacgcaccgatttttccaatctcggcaacctcaagcaccgccagtccgccaagcgtaagtttcggctggttggtcgtcgcaatgatgcggtccttggaatccttgtacaggaatacttcgatctcatccccgagctttgcgtccgccggcacctgcttctgcggcagaagcacacgcgtctcatctccctcatgctccgccagatagactccaaattctacttttttgatcacttttaacttctgatattcgcctaatttcatctcgatcctcattttccatcaattcttctctgccgccgcaaattccacgatcgcatagatctggtctccgccgtcagtcagcaccaccgttatcttttcctctgccaccgcaacaaccggatgcagcacgtcgcccagcattgccgcacgtcggtactctgcccgcacgccgccgattgcaaaatcctccggcacagattcctttgccaccagaatgtatttcccgttgttcatgtggtggttggtgtcaataaaaaatcccgccaccggaaccggctgcatcgcagttccgccctccggaaccgatagctttctcgcgccccactcgcccggcagttcttctccgatctccggccggtaggcatccgccactttctccgggatgcgcatcgggcgcatccgctccatatccatgtatacccagacagaattcgccagcaccagttcctctccctgtccgttcgtgatccggaagttgcggtatccataaaatcccttaaatgcatacggccatgtctccacgcagattttctctcccataaccgggtagcgtctgatcttaatctcccaggaagacaatacccacgcctgcttctgctctgccagatattccacgccgatgtccatatcttccgactggaacgtgcagcaatcctgcagataatccatcaccgccggcagtgtcaaatgccgttcgctgtccacttcactgtaacgtacgcgactttcaaactgatacatggagtcccttctttcaatgcctgtgtctgttattatcgtagtaatagtaacacaggggaacaggtttttcaatgacaggaagcagatgccggataaagaaaagacctcatgaacgatgttcatgaggtcttagaagcagggctacaaggattcgaaccttgaaatgacggagtcagagtccgttgccttaccatttggcgatagccctaagtgctgtcaacaaaagctattataacaggtcggcagaaaaaatcaagtgtttttttcaaaaatttcgatttttttgtctacgagtgcgtacaacaccttctcaccccaggaaatccgggcgcttccgttcgtcgcctccacaatttctttttccacttcctgctgctgttctgccggaaccataagctgaagtttcactttttctgtatacacggtgtcgatcagcgtgaggttctgctgcgcgatcagatactgcagctttccaagcccggtatagtccgtgcctaccgtaagctgtatgccttccttcttatctataatggtactcgacgcaagccccgcctgcacggctccctgatacgcccgcaccagaccgccggtgccgagcagcacgccgccgaaataccgtgtaaccacgaccgccacgttgtgaatctcctcccgcagcagcacatcaagcatcggtctgcccgccgtctgcgccggctcaccgtcatccgaacagcgacttaactcctgccggtctccgatcacaaatgcggaacagttgtgtctggcgtcccagtattttttcttcatctccgcgatgaatgccaccgcctcctcctccgaggcaaccggccggaccgtcgctataaatctggacttcttttctacaatctcaccctcgccgccgatatacactgtcttcatatgatccacaatcccgccacccgggtcctttcccttcgctttccactcttttcaaatagtaacacggcagctttcttttttgcaatacgaatccttaagaaactgtgaagaatgtccgtattttcagttttttctttattctgacacagttctttggtataatacattgatggtgaatcagaaaaggaggcctactatgaattatggaaagaaacgtactcggaagcgcgagcatgaacttgcttccaagggtaccatgattcgcaaaaaattcaacgtaattttttgtaaggcattgcttatatgcttttttgcagtcgtgattgtcggcggatgctccgcgttcggagtgatctccggaattattgcttccgctccctcaatcgaagatatcgatgcaaccccgactggataccttacgaccgtgttggacaaccagggcaaccagaccgcaacgctcgttgcatccggttccaaccgtaaatacgtgacgatcaacgagattccgatcaatctgcagcatgcttttgttgcgatcgaggatgagcgtttttacgatcacaacggtatcgatctgcagggtattctgcgtgcaggattaaaaggcgtcgcatccggttttcatttttcggaaggcgcaagtaccatcacacagcagctgctcaaaaataccgtgtttacccagtggacaagcgaacagtccatggcggacaagttcgagcgaaaattccaggaacagtacctggctctccagctggaaaaggttgtggacaaggactggattctggaaaattacttaaacgctatcaatcttggtcagaatacgctgggcgtcggcgtcgcatcggagcgctatttcggaaaagatgtctcggagctgacactttccgaatgtgccgtgctcgcggcgattacccagagcccgagctactacaacccgatcacacacccggatcacaacaaagaacgccggcagaaagtcttgaacaacatgcttgatcagggctatatctcacagaccgagtatgatgaggccgttgcagacaatgtgtacgaccggattcaggtcgtcaatgtagagtcgcaggatgagaatatcaattcctattttgtagatgaaatgacggatcagatcgttcaggatatgatcgaccgtctgggctacacggagacgcaggcttacaaagctctctatcagggcggacttaccatcgagtccacgcaggacccggatatccagaatatctgcgatgaagaggtcaacaatctggagaactacccgaccgatccgaaggtatccttctcctaccgcgtatcgatccagtccccggacggcaccatctcaaattacagccagcagacgatgctttcctattatcagaagtcaaacaagaactacagcatcaactttgccagcgaggatgacgcccgcgcagcgatcgagcagtataagatggatcttatgcaggacggagacgtcgttgtggatggcagcgagacgcttacctttaccgtccaaccgcaggctgctttaaccgtcatggatcagtccacaggagaagtgaaggcactcgtcggcggacgcggcgacaagacggccaacaagacgttaaaccgtgcaacggacaccacaagacagccgggttctacctttaagattatcgctgcctatgcacctgcactggacgcgggaggtctcacacttgccgatgtccaggatgatgcgccgtacaattacggttccggacagggcggagcggtaaataactacgacaagcgctaccgcggtttcaccacactgcgcgaaggtatcattgattccatcaacgtcgtagcggttaagacgctggcgcagatcggtccttccctgggttacgattacatccgcaactttggttttaccaccgtcggcatcgacgagagcggcaacgagacactggcactcggaggtctcaccaacggtgtcaccaacctggagctgaccgccgcttacgccaccatcgccaacagcggaacctacatcaagccaaaattctatacaagaattctggaccatgacggaaatgtactgcttgacaatacggcaccggaatcgcacaccgtcctgaaggagaccactgcatggcttctgaccgacgccatgaaggacgtcatgacacagggaaccggtacgccggcctacttcggaagcagtatggcgcaggcaggaaaatccggtaccaccaccaagaaccgtgatgccctgtttgccggattcacaccttattacacctgcgtggtatggggcggttacgacgacaatgcggttcagaacagcggacagaccacctatccgaagaagatctggaaagcggtcatgagccggattcacgaggatcttccttatgcggactttgaaaaaccggacggcatcgtcactgctaccgtctgcaaagaatccggaaagcttgccatcgacggcgtatgtacgaacgatccgcgcggcaacatggcatataccgaatattttgcaaccggcacggcaccgaccgattactgtgaccaccatattctggccaacatctgtgcggattccggacaactcgccggcgcaaattgtccgaacacctacgcaaccggcgtatacgtgattggcggctctgcgaacacagaggatgctccttatcttctgaccgaagaggctctcgccaatacctgtacgatgcacaatgcaccgtccacaccgtatgagtcgacgccgtacacacctgttccgggcgtgacggatctcccgtcgcaggataccaataccggaaccacagacaacagcacctccccgggtgacagcggcacatcgacgggtgagaatcagaccaccggtgacaataccggcggctctgctgagaataccggcggcaacgccgacggcagtcaataaaaagatgcgcccgggttttgaaactctcaaaacccgggcgcatttttttatctgtcatgttttaattctctgtaaaggatcttaccgtctgcagtacctcctccgccttgtccagcgattccgctgcatgttctccctgctcactgcaaaaatcgatggttctcgcctcaatacgctccagatgccctctggcctccgcgctgagtgcctccggcgtgtattctttgatcgtaagtcctgccagccgcttcatataacgattcgtcgtctctctggcctggcgctgactgcgcatgcgctgatccatgatctcaatctcgcgctcctgcttttcctgctcctgtctccgcgcgcctgtatcctcctcatttttgacctgcacggcatgatattcatacgcctcctcaagcgcctcccagaatgctccacggaagtctaccggacgtaaaaatacacggaatacattccgctcgttgatgaagaaatgaagctgcgccgaactgattgtggtcgtatagatgatacaaacggtactgggtgccgtcttgttcagatacgttatgatctgctccccgttgtacccctccagggatagtcccgttatcacgatgtcgtaattctttttcttgatctttgccgccgcctctatgccgtttatcgccgtctcaatctcaatatcccgatccttcatcgcatctgtaaattcatgaatgatctggggatacttgctgatgaacagcagattatgctttgtatcgtcctgtcccatatcacattcctcctatgtcgttgcctttacttcttccacaggtctcaaattatttttccaaccctatatatctgctgatatttcccacactacttttcgtttattttcttatcttgaattataatggaatgtccccaactattcaatagacttcttctccactttctccctcagatattctatccgcaaaactgccttcgcagattttttcttcgtatttactgtacaatcacaatttatggcctttacagtcaaaaacgcgaaagcgcccggcaatctgccgggcgttcccgcgttgatgtatatactaactaaggggattagattcaccaatctaatcaaattagattagtgcatattagtgtaactctctggatacgaaatccggatagccggactctaatccatgctctgtcgagtcaagaccctcgatctcctcctctgcggtgactctgagaccgatcgttttctttaatacggtaaacacgattgtcattgtgatgatcgtccatcctgcgatgcagaggattcccaggcactggatggcaaggtgatgtacaccgccgccgtagaacagtccgtccttgtaatcaaagaatcctaccgcgagggtaccccagataccgttgcagccgtgtactgccactgcaccgaccggatcatctactttcagtttatcctcaataaagtatactgccacgcagacaagcacacctgcgactgctccgataacaaaagctccgattgcatctacgttcgagcatccggctgtgattgccacaaggcctgccagcgaaccgtttaaggacatggacacatccggttttccgtttctgatccaggtataaagcattgcggttacggttgcaactgccggtgcaatcgttgtggttgcaaaaatctgtgacagctgcatggtgtcggttgctgctgcgccgttgaagccgtaccagccgaaccagagaataaatacgccaagggcaccgatcaacaggttgtgaccgagaataggcttcggcttgccgttcttgtcatattttccaatacgcggtcccaacattgccgcaccgatgaaagcagtgataccgccaaccatatggatgcaggcagagcccgcgaaatctgtaaatcccatgtcggtcagccacggtgtaccgccccatacccagtgagcttcgatcgggtacacacataagctgatgataaaactgtagatacagtaggtaatgaactttgttctctctgccatggcaccggatacaatcgttgcagcggttgcacaaaataccaggttaaacacaaacgccgaccagtcggtctcgccgaaattcgtaaacgggttcagtccccagccgacaaattttccatcgccgcacaaaaggttgtaaccgagcagataaaacgccacggttccgatacagaaatccatcaggttcttcatcgtgatatttccgacgttctttgctctcgtaaatcctgcctctaccatggcgaatccacattgcataaaaaagactaacgctgctcccataaggaaccatacactcatatccataagcttatcctcctgcaaaaaaagaggataacagcgagcacagacattcctgtgttctctattatcccctttgataatatgttacaatatttgattttttcataataatctgtagtgctccttcatcgctcctatagcaggctcctcaattcctcctataacagcactcctcaaacaggcttacaatgctttcgtgccatgctcacctgtacgaatacggattgcatcttcgacatcatacacgaagatcttaccatctccgaaatgtccggtgttaatctcatctacgatcttgtcaatcagcttcggtgcaacttcgtctgccacaaccgtctcgactttgatcttcggaagcagattcacggaatactctgcaccgcggtagttcttaataattcccttctggttaccatagcccatgctgttgacgatattcaaaccgtttacttcctcggtatccagcacgccctttaagtcttccagtttttccggcttaataataatttccagttttttcatgccaagctcctcctttatattcagttttagcgaaagcgctactcccatccctctgctgttcacagtttattcatttaagattcaaaaatctttcatcctgtaaacatgaaattttcatttctgctccatatactataaccatacaaatgatagttatcagtatttgttactacccacaaaactttttcataatctgccaggtgacggttgtcacctggcaatcctcccctttcggggagttttttctccctttaggggggattttttatttaggaggttgatggtagcaactatacctcgaaaatcaaatctccataggacggcatcggccacattgacttatcaactaacatctccagcttatctaccggcgctctgagttcatccatcgctgtctttaccgtatctctgtagtatacagcctgctctctgccctcatccattgcagatgctttctctgtcacatcctttaacttgtcgagagcattctgtgcgtctgccagaagatcggatacctctgtgaggatctctgtctgcgcgctgatatctgcgccgcatgcactctttacggcattgatggactgtgccagtaccgttgtatatttgataactgccggaatgatctgctttgcagcaatgtcgatcattgcctttgcctcgatattgatctcttttgcataggtctcatactcgatctccacacgggaatccagctcagccttggtaaataccttgaacttctcaaacagtgtcactgccttctctgtgttgagtgccgggatcgcatctaccatggagcggatgttcggaagaccgcgcttctctgcctctgctacccactcgtctgaatatccgttgccgttgaatacgattctctgatgctcggttgcatactccttgatcagatcatgtactgccatgtcaaagtcatctgccttctctaagacgtcgcatgcctctgcaaatgcctctgccacgatcgtgttgagtaccacgttcgactgggcgatggaatcctgggaacctaccatacggaactcgaatttattgcctgtgaatgcaaacggtgatgtacggttacggtcggttgcatccttcatgaaatccggaagcgtcttaacaccggtctctaacttcttgccggagatactgtgtgttgcctcaccagtgctgatcagctgtgaaagcacatcctgcagctgctcaccaagatatatggatacgattgctggcggtgcctcgtttgctcctaatctgtgatcgtttccgacatctgctgctgcctctctcaagagatctgcatgcctatctactgcttttaagatgcaggtaaggactaacaggaactggatgttctcatgcggtgtcttgcccggctctaagaggttgatgccatcgtctgtcgtgatcgaccagttgttgtgcttaccggaaccgttcacacctgcgaatggcttctcatgaagcagacactgtaaaccatgacggccggcaactttcttcaatgtctccataacgagctggttgtgatcgactgccacgttcgcctctgcgtagatcggagcaagctcatgctgtgccggggccacctcgttgtgctgtgtctttgccgtaacgccaagcttccagagttcctcattgacgtccttcatgtatgcaccgatgcgctcacgaattgatccgaaatagtgatcgtccatctcctgtcccttcggcggcattgctccgaataaggtacgtccggtaaagatgagatcctttctctgtaaatacttctcgcggtctacgataaagtattcctgctccggtccaacggacggtgttactttctttgatgtagtatttccgaataattttaataagcgaagtgactgctcattgattgcttccatagagcggagaagcggcgtcttctggtcaagtgcctcacctgtgtaagaacagaacgcggttggaatacaaagggttgcacctgctgcatcctgtctcacgaatgccggtgatgtacaatcccatgcggtatagcctctggcttcaaatgttgctctaagacctcctgacgggaaagaagaagcatccggctcgcccttgatcaattccttaccggaaaagctcatcagcactttaccattctccatcggagctgtgataaatgcatcgtgcttctctgcggtcacgcctgtcagcggctggaaccagtgtgtgtaatgggtagcgcctttttcaatcgcccactctttcatctcatgtgcgacaacatccgctgtctcgagatccagttcttttccctcgttgattacttcctttaacttcttgtagactttcttcggaagacgttcctgcattactgcatcgttgaatacgttttcaccgaaaatctctgctgcattaaggtatcctgtttcgctcatcttctacatcctttcttctcactaatccaatcccctaagaccagacttgcttattctaatgtacgcgatttcctgtcggatttcaaccagaacttcatgtaaagttctgtatacagaaaaaagggcattccaagtctattggaacacccttgttcatcgctcacattgttttgttggtattaagataatactttttaaaacgaaatgcaagcgaaaactttatatatttttaatttttacacttctaacaaaaataataaagttctagtcaaattattgtgaaaaaattctgttgtccgacaaaacaacttcattccataaagaattagtcgtttgccttacctacggaaccgaacagctccatcttctcttttacagttgccttgattgcctctgcgccaggagcaagaagtttacgcgggtcaaagcccttgccttccagatccttgccagcctcgatatatttacgtgtagcatctgcgaaagataactggcactctgtgtttacgttgatctttgcaacaccgagagagattgctttcttgatcatgtcagccgggatacctgtaccaccgtgaagaactaacggcataacgcctgtcttctgctggattgcatccagagtctcaaagcttaagcccttccagtttgccggatattttccgtgaatgttaccgatacctgctgcaagcatatctacaccaagatcagctacacgcttgcactcgtccggatctgcgcactcgcccatgccgacaacgccgtcttcctcgccgccgatggaaccaacctcagcctcgatggacattcccattgcatgtgcaacctgaaccagctccttggtcttctcaacgttctcgtcgatcggatagtgggaaccgtcgaacatgatggatgtgaatccagccttgatgcacttgtagcatccttcgtatgtaccatgatccagatgaagtgcaaccggaactgtgataccgagctcatcatgcattgcctttaccatcgctgcaactgtaccgaaaccggtcatatacttaccagcgccctcggaaacaccaaggattaccggagactgtaactcttctgctgtcaggagaacagactttgtccactcaaggttgttgatgttgaactgacctactgcatagtgaccagcttttgctttttctaacatttcttttgcagatactaacataatgaattcctccataacttaatcaatttgccgcaatgcggcagttgtttttaccctaccgctattatatattacttcctgtaaaaaataaagttaaatttttaacaaaacatacttcccgacaaggtctctcactcgccctgcggcaccataatctcgactgccttgcacaggttcttcaccacgacctcctcatggtcgccgccgaattctccatccagcgtccacgggattgtgttcttcgccgtgaaccgcacttcgctggtcttaaacgaataaatcatgtccgtatcgtccacaagattgatcaacgatgcgatgatctcgtttaactcgatcgggttcttcggctttttgatgagtgtgacctcgaagactccgtcatccagcaggacgtcctttccggtcatccccttaaatccgcccacggaggtggaattgctgatcatcccgtagatgaactcgtcctgaagacgcacattgtcgtactctacctgcatgaggaacgacgggatgtcgtgcaggcacttcgcgccctctaagatgtaagccgcatgtcccagcacattcttccactcctgactcgtcttgtaggagacttccgtaaacagcccaaatgccgccacgtacacgaagaagtccccgttaaacgccccgatatcacacgggaacgcccgacctgcaacggctgtctccgccgccttgaccatatttttcggaatgccgagcgatgtggcaaaatcattcgtgctgcccgccgcaatatagccgagcggtacctttttctcacggtgcatcatccccgtcaccacttcatccagcgtaccgtccccgccgctgcacacgacgagatcataatcgccggcttccatctcgatcttatgtatcgcgtctccctgtgcctgtgtcggatagatggtgacctcataatccgccttcaccatcacatccacaatatccaacagctgattcttgatctgtgccttgcctgaaaacggattaaacacaaacagtaactttttctttgtacccattatttatacacccttatcttatttctttctatgagacgaggaattcctcaatcgctgcaacggcttccgcttcgtccgctccctctgcatccacaagaatctcctcaccgtttaacaacgccagactcatcatccccataatgctcttcgcattgacacggctgtcaccatgttccagatagattttgctttcataccggtttgccacctgcacgagatttgcgatcggtcttgcctcaaaatcctgctgcatctttactaccacactctttttcattgcatcctcccatcctcgctttttaacttacaccttacactgtctgctgccggaggctgtctgccatctcgctgattctgcgaagcctgtgattcacacctgattttcccacaggaggattcaggtaggttcccagttctgcaagcggcgcatccgggtattccagccgaagcagtgccatctctttgagattctccggcagatatgacaagccggccgtctctcttatatattcaatgtccgcaagctgtttgactgcagcgtttaccgtcttgctgatattcgctgtctcgcagttcaccttgcggttcaccgaattacgcatttccttcagaatccgcacattctccagattcatgagcgcaacatgcgcctccataatgtttagaatatctacaatctgcgagccttccttcaagtacacaacctgatattttttgcgtgccacaatcttggcgtccatgtcaaagctgttgattacatcccgaagctgttcggcctgtgggatactgcggcatacaatctcaaaatggtaggatttgttgggatcgctgatcgatcctcccgccagaaacgcccctcttatgtacgccctcttgcagcagttctgctgaatgaggagtcccttgaccgtatcttccggctccgcctcccccgtggcatcgttgtacattttaaccgtggaaaaaacgctgcgcgcctcctcctcggtatggatttcttctatatgaaacagttctgctaacagcagctgatatttttgcatcagcagccggttctccgattccgccgcagggattcttccctcaaatgcaatcagcgccgccagctctgcaatctggcaatgtctgctttttcccagatgttttgccagttccgtttttacctcacttgaaaatgacatagcttactccaaccgtccctcgcgtccatcggctcttccttttgtctgcggggtctatttcccgcggagcgcatctttaccgatgtcgcggtgctctattttcagtccgtatcccttttgtccggaaagccgttcatacagcgcattggcgagcgtgaccgaccggtgctttcctccggtgcagccaatggagattacaagctggttcttcccttctgcaatataattcggaatcaggaagttcagcatatcctcgagcttgtccaaaaacgtatgcgcctcctcatactggaacacatagtcctgaatctccttgtcattgcccgtctttgcccgcaatccttccacataatacggattcggcagaaaacgcacgtcaaagaccagatcggagtccgccggaatcccatacttaaatccaaacgacagaatcgtgataaacagattcttatagtcctgattctgcacaaaaatcttatccagctccgctttcagctccctggtcagaagctggctggtatctataatatagtctgcactctctttcaaaaatgccagacgctttctctcttcttcaatgcccttgtccacccggtctccgccggacagcggatggtttcttctggtctccttgtagcgcttgaccaatacagaatcctctgcatccagaaacagaatctcgtagtgaaccttcttttttttgatccgcgcaagcacgtcgcgtatctcttccagtgcctggccgttccggatgtcaataccgaccgccactttctgcagttctgcattttcctgcaggctcgacagctccacgaacttttcaagcaatgcaatcggaagattatccacacagtagtatccgatatcttccatcatcttaattgccgtactctttccggctccggacattccggtcaaaatcacgaacttcatgccagtcactctccattcctgcgtatcctgctgttatctttgtctatcgggctaaaattcgccaagcatcttaatctccggttccagcttcacctgaaactgtctgtccacctctgcgctcacatccgcaatcagcgtcctcacatcctgtgcggtcgcattccctgtgttgaccacaaatccgcagtgtttctgcgatacctgtgctccgccgacccggtatccgcgcaatcccgcatccatgatcagctttccggcaaaatatccctccggccgtttaaatgtgcttcccgcactcggatattcgagcggctgcttttcggcgcgctgcgtggcaagttccttcatccgtgcccggatggcctgctcctctcccgctgcaagcttcaataccgcctgtgtgacaatatagtgcttctttaaaatgcagctcgtgcggtagccaagctccagctcctccacggacagcacatgctgtactcccgtctcatcgagcacggtcacagtctctatgatgtcccgcatctctccgccgtaagctcccgcattcatcacaactgcaccgccgatcgttcccggaatcccggctgcaaattccatcccggtcagcgcatgtgacgcagcaagcgacgccgtgcgtgacaggagtgctcccgctcccgccgtaatccgcacgccgtctgccgaaatctcatccatcccgtctctggtaagaatgaccaccccacggataccaccatctcccaccaggaggttactgccgtttccgacaatgtaatatggctctcccgcctcccggcatgcaccggtaactgctgcaagtttctccgcttccggcgtcaccagcacatccgccggaccgcccacacgaaaggtcgtgtggcggctcatcggctcgttcggatgaatattttcttttcctgcgatctgttctaacgtatccaataactgttgtttcatgcctgttcctttaaaaatgcaatatagccgcgatatgcctcatacagatccaccttgctgatgatctcccacggtgcatgcatgttcagcactgccacaccgctgtcaatcacacgcatgccatagttggcaagaatgtaggcgatcgttccgccgccgccctggtctaccttgccgagttctgccgtctggaatgacacctcgttgcggtccatgatcgcgcggagtgctcccacgtactctgcattcgcatcgttcgatccggatttgcctctggctccggtatatttgttaaacacaagtcctcttccaaaatatgctgcgttgcgcttcgtcatcacggacgggaagttcgggtcaaatgccgccgatacatccgaagagagaacgctcgagttcttcagtgcacgtctgagtgccagttcagaatacgttcctgccgcattcatcacctctgcgaccgtattctcgaagaaacgggactgcataccgctcgcaccgacacttccgatctcttccttgtctaccagaaggcatacacttgtgatctccggcttctccatcgccgcaatcgcctcaaaggaaggatatgcgcacactctgtcatcgtgtccgtagcccataatcatgcttctgtcaaagccgtagtctctcgcttcgccggccggtacgacctcaatctccgcagagaggaaatcctcttcctctatatcatattcctttgcaaggatcttcatgatattggcttttaccttttccttgacgtcgtctttttcatccgcttccgccggaatgctgccgatgatcagatcgaggttttctccctcaatgaccttggctgcctttttctccatctgctctccggaaaggtggatcaaaagatcgctcacgccgaataccggatcacccggcttgtctccgacactcactttgaccacggtgccgtcctttttcgcaatgacgccgtgcagagccagcggcagtgtcacccactggtacttcttgataccgccgtaatagtgggtatccagcatcgcgaaatccgtgtcttcatacagcgggtcctgctttaagtccatgcgcggggaatcaatatgtgcgccgagaatattcatgccgtgctccatgctcttctcaccgattacgaacagggcaagtccttttcccatattgtttgcatatactttatctccggctgcaagctttgtacccttctccagcacggtatccagatttacgaatcccgccttctctgctttcttggcaaaataggtcacgcactcgcgctccgtcttgcagtctgacaaaaacttacggtactcctccgcaaaatcaaaaacttcgtctctcttttttccttccgggtatttctcccatgcattctttctttccattgctgttgtttctcctaacctatattgatctattcgtctttattgatctattcgtcttcctcatcgtcggacttcttcgtcaggttctcttgtacacggcggtacagctcctgtgcggcattgtaacccatcttcttctgtctgtggttgactgccgctgcctcacagatgactgcaaggttacgtccggcgcggatcggaagcgaatgacatacgactttattgccgaggaactctgtgtactcctcctcaagtcccagacggtcatactcattatccttcttccagtcttccagcttgatgaccagatcgatctgctgcttctccttgacgccctcgacaccgaacagcgtcttcacatcaatgatgccgattccgcgcagctcgataaagtaacgtgtgatgtccggtgaagtaccgatcagcgtatgctcgttgatcttgcggatctccacgacatcatcggttaccagacgatgtcctctgcgcacaagctcgagtgctgcctcgctcttaccgataccgctctctcccataatcagaagtccctcgccgtagacatctacaagcacgccgtgaatggtgatgcacggtgccagctgctcgctcaggcagtagatcagctccgccatgaactcggatgtgcttcgcttggttccgaataccggcaggttgctctcctccgcaattttgaggaacatctcgtccggctttaaatcacggcagaaaatgacgcacggaatatcgtaagccataaactcccggtaaatcgcttcttttttcttctcatccagctgttgcagatacgtgtattccacggtaccaatgatctgcacacgagactgctcaaaatgctcgaaatagccgctcagctgcaatgccggacggttgacatcacggatcatgatccgatgtccttttaattccatctgcggaataaaattgcacagatcgagaatctgcgccacttttgctacaccaacaccactcatcccttacgctcctttgtatgtgatttacttttgtgcaaattataccataggcacatggaatcttcaactaatcggacggctggttttcccgttctttctcccggaaaaaccgataaaccgagcgcgctgcctgcgggctcatgctgtccgtctgtgcgaggtcttcctccgtcgcctcccggattgcctccagcgactgatattttttcatcagcgccttgcgccttgccggtccgatatccggaatgtcatccagcacggaatgtacctgctccttgctccggagcgaccggtggtactcaatcgcaaaacggtgcgcctcgtcctgaattcgcgtaatcagcttaaatccctcgcttccacggtcgatgggtatctctacattatgatagtatagcccgcgcgtgcggtgattatcatctttgaccattccacagaccggaatattaagatgcagctcctccagcactttgagcgcaatgttcacctgcccgcggccgccgtccatcatgatcagatccggaaatcttgtgaaactgccgtactcctccgacaggtccttttcttccatctcctccatctcacgcatgccatgcgtaaatcttctcgtcagcacctcatacatggaggcatagtcatccggtcccgacaccgtccgcagcttgaacttccggtagtcactccgctttggcttgcctttctcatacacaatcatggaaccgaccgactcaaaaccgctcgtatttgagatatcgtacgcctccacgcggtttaatcctttcatatctaaaagctgttcaatctcctttaacgcgccgatcgtcctgccttcctcgcgcttgatcttctcgcgatcctgcgcaagaaccatcttggcattcttctgtgcgagttccaccagcttttctttcatgcccttctgcggtacccggatgtaaaccttgctgccccgcttctcgccaagccagtcggcaagcacctcctgctcctcgatctcctgcggcagcataatctctctcggaatgaacggcgttcccgaatagaactgctttaagaatgtggtaaggatctgggctttggtgtcctccgttccgatcttcacataaaaatggtctctgccgatcagcttgccatcacggataaaaaatacctgcaccaccgcgtcgcggtcatccgccgccagcgcaataatgtccttgtcctcgccgtccgtgtgcgtaatcttctgcttctgtgcgatctgtctgacactgtttaaaagctcccggtactcaatcgccttttcaaattccagattggccgacgccgtattcatcttctcttccagagactttagcaccggcgcataattgccatttaaaaattccaccaccgcatccacgcgctcacggtacgcttcctttgtgatatatccctggcagggcgccgtgcactgatgaatgtgataattcagacacgggcggtcctttcccgtgtcgcgcggcaggttccggttgcaggtgcgcagctgatagatcttgttcaccagctcgatcgtatccttgactgctcccgcgctcgtgtaaggaccaaagtaccgcgatttgtcttttttctgctggcgggaaaagagaactctcggaaaatcttccccgagagtcactctgatgtacggatatgtcttatcgtcccgcagcatggtgttgtacttcggccgatgttctttgatcagattacattccagtaccagcgcctccagttcggaatccgtcacaatgtactcaaaccgcgcaatctgttttaccatctgcgcttttttgataccctcatcatggcttggctgaaaatactggtgcacccgcttgcgcagactgaccgccttgccaatgtagataatggcatcacggctgtcatgcataatataaactcccggctgatccgggagttttttaagttcttcttcaattacaaacattactgttcctcatgatcctgcgtattgcgcagcaatacatcatccatgttctgactctctgcggcagtttttccctcctcgagttcctgacgggcttcctccgcctgctcgaagaacgtcttcttctctgcctcgtcctccggctccgggattcctttcagttcacggaaaatcttcatgaattccttaccggtaatcgtctcatgctcgtagaggtattctgcgatatgatcgagcacctcccggttctccgtgaggagacgtatcgcctcatcatatgcgtgattgataatggcaagtacctccttatcaatctgcgccgccgtgtcctcaccgcagatcagtcctgcgcggttgtccagatactggttctccaccgtcgccaggcacatcataccgaacttatcggacataccgtactgcgttaccattgccctggcaatcgccgtcgcctgctcaatatcgttcgccgcaccgctggttgccgactggaataccagcacctccgctgcacgtcctgccatgtaagtggtaatcttcgctaaaagttcatccttggtctggagatacttctcctcctccggcgtctgcagcgtgtagccgagcgctcccatcgtacgcggaacaatcgtgatcttctgtaccggctcggtgttcttctgaagcgccgtcaccatcgcgtgtccgacctcatggtaggacacgatcttgcgctccttgtcactcatcacgcggtccttcttctccttgccgccgactgccacaagttcaaacgcgtcaaacagatcggactggttgacaaactttctgccgttcttgacggcattgattgctgcctcattgatcatattggcaagatcggaacccaccagacctgccgtcgcaagtgccagtgcatccagatccacggtctcatccatcatgacgtccttggaatgtaccttgagtgtctccagacgtcccttcagatccggcttgtcgacaatgatccggcggtcaaaacgtcccggacggagcaacgccttgtccagtacctccggacggttggttgcagcgagaatcagaattcccttggacgtgtcaaagccgtccatctccgcaaggagctggttcaatgtctgctctctctcgtcgttgccgccgtaacgggtgtcacggctcttaccgatcgcatcgatctcatcgataaagatgatacacggtgcctgcttctgtgcttccttaaacagatccctcacacgggaagctccgacaccgacgaacatctccacaaaatccgaacctgccagcgagaaaaacggtaccttcgcctcgcccgccactgccttggcaaggagcgtcttaccggttcccggaggtcccacaagaagtgcacccttcggcagcttcgcaccgatgtcgcggtactttttcgggttgtgcaggaaatcgacaacctcctgcagcgattccttcgcctcatcctgtcccgcaacatccttgaacgtcacgccggtctgcttctccacataaaccttggcgttgctcttgccgacgcccatagcgccgccgcccatccggcgcatcaccacgccgagcacaacccagatcagcaccagcggaatcaggtagcttaaaatactgtaaatccaggtggatgtgttatccggaatcactccgctgatatccacgcccttttccttaagtaacggaatcagctcatcatccgccacacgcccgcagtagtaagtcacctcgtaaggtgttttctcatcggaattcagtgtgatgtcgatctggtacgaaccgatctccactgacttcacgcttctgccttcccatttgccagtgccgttcaccatgtcgagaaactccgagtaagacacctcctgcgtgctcatctggttgaactgattggttacaagactcataataaacagcgcaatcagtgaaatcagtataaatgccatcaaaatctgaccattgtgattccctttgccgccgtctccgttattccctccgtttgaattaccgttattgtaattgttattcgatccctgattgtccattgaagtatttatcctttccaacaggctccgccagttcagagtctggattcttatcgtatatcttctatattatattgaaaatggaatttaaaagcaatacgttcttcgtgaagttttcctgtcatttctaaaataattctaaaatttcccggcatactattttctgtgtttttgaaattgtgctggattttccggacacttagttgtatactgtatgggttatatagatcgtattactattattcacacaactgtacttttatatgaggaggaaaaccctatgcctgtaaaatatgtctttgtcaccggtggtgtcgtttccggccttgggaaaggtatcacggctgcttctctgggaagacttttaaaagcccgtggctacaaagtgaccatgcagaaattcgacccgtacatcaacatcgatcccggaaccatgaacccgatccagcacggcgaggtatttgtgaccgatgacggtgcagaaacagacctggacttaggacattatgagcgtttcatcgacgagagcctgaccaagaattccaacgttacaaccggtaaggtatactggtctgttcttcagaaggagcgccgcggcgatttcggcggaggtaccgtacaggtcatccctcacatcacaaacgagatcaagagccgcttttaccggaactttacttccgaggagacacacattgccatcattgaagtcggcggtaccgtcggcgacatcgagagccagccgttcctcgaggcaatccgtcagttccagcacgaagtagggcacgagaatgccatcctcattcatgtaacattgattccatatatcaaggcatccggcgagcttaagacaaagccgacacaggcgagcgtcaaagagctgcagggaatgggtatccagccggatatcatcgtctgccgttccgagcatccgctcgatcagagtctcaaggacaagatcgcgctgttctgtaacgtgccgaaccgcaatgtacttcagaatcttgacgttgaatatctctatgaggcgccgcttgccatggagaaggagaatctcgccaaggttgcctgcgaagcgcttcatctggactgtccggaaccggatttaaaggactgggaggcaatggtcgacgcactccgtcatccgaacaaggaagtgactgtcgcattagttggaaaatataccgcacttcacgacgcttatatctccgttgtggaggcgttgaagcacggcggcattgcggagcgcgcaaccgtgaatatcaagtgggtggattctgaggacgtcacaacagagaacgtggacgagatcttatccgatgtatccggtattctcgtaccgggtggattcggttcccgcggtgtcgagggaatgatccttgccgcaaaatacgcacgtgagcatcagattccgtaccttggtctgtgcctcggcatgcaggttgcgatcatcgagtacgcaagacatgtctgcggcttcaacgatgcgcacagcatcgagcttgatccaaacaccacgcatccggtcatcgcactcatgccggatcagaacggcatcgaggacatcggcggaaccttacgtcttggttcttatccgtgtattctggacaagacctccaaggcatacgaggtatacggtgctgaggagatccatgagagacacagacaccgttatgaggtcaacaacgacttccgcgcttctctcaccgagagcggcatgaagctctgcggtacctctccggacggcagaatcgtagagatgattgagattccggagcatccgtggttcgttgccacacaggctcatccggagttaaagtccagaccgaaccgtccgcatccgctctttaaaggctttgtggaagcttcgattcggtgcagcgagaaataagatagataaaaaaggaagggagcgcagctttaaagttgcgcccttccctttttacatctggtgtcttaccaccgcatattcatcgtccagctgataatacggacattctctgtaatgtccctgcatcagtctcgccgcatcatcctcatccatatccacttcacagtagtaggtctcgtcatcttcatcgtacacattgtatacacagctgtcacagcttgccttcgccataagacgtcctccttttcgcatttctgttctatttccatgttgaaatcacttcatcgtacagccgcaacagaaaatcgtgcagcaattccctctgtgtatcccagtagacctccgtgatctcatcaccgtcctcctgcgcttccgtcacatccatcaccgcatccagaatctccgggttcagatcatccatcgcctcctgcacggcagcctcaaaatcacaatagctgtcactggtcagatataggataaaattctcccggttcaggtttctcgcctcatagcttcccgtaaacagatcgttcccgatcgatgcgatccgctcaaactcttccttgaccgtctcatattcgacggtgcagtaactctctttaaaaaatttatcaaatacttccttgtctatcttctgtcccattcgtttcacctcttgcaatttctcgtgtgccgtgctattttaacataaaattaagaaaagaggaacccataccatgaatacacttcccaaagatcccgtcatgctcttaagctttgtcaacacacagcttcgtgaccactacccgtcgctggaagaatttgccgcaacctaccagattgatgctacagaggttatctctgcattaaaaaatatagactacgagtacgatccggcgaccaatcagtttatctgatccgtcagccccgcttcttccggcacgctaatccacagtctcgtcacttagatattttcgcacgcgcttccagtccgggtaaaacttcgtcatgaatccccagaagcgctgattgtggctcgcctccagaatatgtgtcatctcatgtaccacgacatactcgaggcactccggaggcttggacaagagcgccagattgatgttgatgtgatgtgtctgcacattgcaggacccccatctcgtcttcatctgccggatggtgattccggagactttcaccctcatcaccggctcccattttgccacaagacgctccacctcacgctttaactgtttctttctgcgcgcgatttctgccgcatccagctcccgtttttccgaacggcgctctccggcttctttgtatttctgctgatatttccgtatccattcgatccgttctctggcaaatgccgcaatccgcgcatcactcatctgatgcggcgctgagatccgcactgtaccgtcctctttactgatgcgcagatacatgtttttcatccgttttttcgtgacaatgatcggcacgccctctatctttatctcataagtgcgctctctcatagttcctgctccccgtatgttttcaaaatagtttccagatactcgcggtattcccgcacaacagattccggcgactcgatccgcactgccgcgccaagtccagccagccagccgaaaaactggcggctgaccgcgacactcacccgcacccggattcttgtctcatcataccggcgcatcgcgacctccttgccgaaacggtcgatcatgactcccgtgagggcgtcttcgcagattaaggtcacagtctcgtcctcccccgcgaacatgccgaacgtttttcgggaatatgccgccacgtcaaagctcccgaactgctccttcccctctctgctttccgccgtaagttcgatctttagcattttatccacacggtaatggcggatgtcgcggcttctgtcgtcgtaggcgatcagataatagttttcgtcatcccacgagagcagccagggactcacttcatagtaactgccgtcccgccgcagtttcatctctttattgaccgtccattcaaaatactgaaaacggatcttcacattttccgcgatggcattgtaaatcatatctacattataataaatgttttcattgaccgccttgctgcggttggtcaccacgacctgcctgtggagctgctttgcctgttccctgccgcaaagcgtctccagcttggcaatcagctctctcgacttcttcgtcgtgatgaacttcgacgcctgcacggcatccacgagaagttttaactccgccagttcaaatttgcggctggcaagataatatccgccgggtcgctccttcacccgtataatatccagcccgaaatcttccagttcctccatatcggtgtacactgtcttgcgctccgaacggattccgttcgcctccagatagtcgatcacctcctgcgtcgtcacaggatgatcctcgtccgttctctcatataaaagctgcgccatgtaaagcagcttctgtttctgcttctcgcttcttcctcttcccatgacatgttgtcctttccacgcaggtgtccggcatttcttcgcagtgccgcgtgatgacaggcattcgcactatcagccactcgtatattcttcgcactgcatatcacgctccggatcgagtaggaggaatttctcttaaataagaaattccgacctctcacaccaccgtgcgtaccgttcggtacacggcggttcaatcaacttaacaagttgtacacctttcggtgtagtaatctaacattgagactaatccgaatgaggttagtctctttatgcttatagccttttgtatccatccattatgacacatgtgtgcataacgatttcctgtatttgccactttatgtgccgcccatcttggaacaccgagcttaactaaattcttctctttgttttgtggtgttttccaatgtttccaaatacacatgcgtagtctatatctaatgtttccatcaagttctctacagagagttttcatactacctatcttaaagtagtttatccatcctctgataagctgattaagtttccccactttatagctgttgctaacgccccagctacggcaagtgagttccctcattctcttcttaaacttggctactgattttgcatgtggttttgccttgaattgctgtgcacttgtatcgtagtagaatccaaacccaaggcattttaacccttgcggtctatctactttgcttttagtcatgttgaccttaagtcctagtttctcctctatgaatcgtgagatatttctcataactctattcgcagacatttcacttccgaccatgataatacagtcatccgcatatcgcacaaagttgagtcctcgcttctccatttccttatctagttcattcagcataatattcgccaatagtggcgagagatttccgccttgtggtgttcccacaatagaatcctcatattcgtcgtcaatcatgattccactgacaagatattttctaataatagagataacatctccatctttaattgttcttccaataatcgtcatcagtttgtcatgatttactgtgtcaaagaacttttccaagtcaatgtctacaatccagtcattaccatcattcattatatcgagtgctgtcaggattgcctgctgtgcacatctattcggtctgaatccgtaactatggtcatgaaactgctcctcatagattggtgttaatatctgcgcaatggcttgttgtataaatctgtctgttactgttggtactcccaggtttctgacaccgccaccaggctttggtatctccactcttcgtactggctgaggtttatattttcttgtcctcaactgttccttgatgatttcgccgttctttgtaagatgttctttaagttctgtgtacttcattccgtccactccctcggcacctttatttcgtacgacttgcagatatgctctgttgaggttatcgctggatagtatctgctccattagactacttgtctccatgcgttcttttccttccgtctcgcttgatttgaccatcttttgcccgattagttacggcagatgttatctcttctgcaattcaagacatactcaaacttgttgattgttcgccccttcgctccatctccattacagagacttcctcactactatgggctcggctgacttctcacagtttgttgttactaggctaatgaaacctctgtgagacctccacgcttaaggtgcacgctctttcctctcacctatccgccacatctactcgtacttccagcaacttttggacttcatctcttttggcagacttatccctatttccgagccttatatgtgatttctgtccgtcggaccaagagtttgcttacagcttccttcagattccacctcacgatagacacccttgctgttcggctatacacttcctcgttgcctaggcgtgttcgggactttcacccgttagagcgcgcccatggcgcgcaaaccaaaagccgggaaaacctccggtttccccggctcgctggcgcgttcatatggagcaaattcgtccacctcggtttcgcagtgccgcgtgaaaacgcttcgcttttttcacgctgacgtgcattcgcactatcagccactcgcagcggcgcgttctctgtgccagcacagaacgcgccacttctcctgtctgcactgctcattgcttattcacattataccctaattcgtgatgatatggggcactttcttgcaaagccaggtgcaatgtctgttttttcaatcaggtcttgcatcctgttcatttcgtgttataatatagttaagttcataagaattaccgagagacatgagcaaggtaagagcagagacgatgagatcgtttttgtttgccttgctctttttgtatttcaaagaaaaggagaatgtattatgtatgatgtagcaattatcggtgccggagtcatcggcagtgcaatcgcaagagaattatccagataccaggcgaacgtctgtgtcatcgagcgcgaagaggatgtctgtgacggcacctccaaagccaacagtgccatcatccacgcaggcttcgacgcagccccgggttccttaaaggcaaagttaaatgtccgcggcaacgagatgatggatgccctctcaaaagacctcgacattccgtttaagagaaacggttccctcgtcgtatgtaccaaagatcaggaccgcagcggtcttgatgcccttttagaaaagggtgagaaaaacggagtacctggtcttcgcatcttagagcgcgaagagctgcttcagatggagccgaatttaagcgacgacgtgacctgcggtctgtatgccccgaccggcggcatcgtctgcccgttccacatgaccatggcatttgcggaaaacgcatacaccaacggtgtttcctttttcttaaataccaaagtcacttccattcggaaaaaagacggcagttacacgttagagaccatccacaccgacacggatacaccggaaacctttgaggcgaaggtcatcatcaatgccgccggcgttcacgctgacgaatttaacaatatggtaagtgaacacaagcttcatattaccgcccgcaaaggcgaatactgcctgctcgacaaagaagccggaacgcatgtatcgcacacgattttccagcttccatccaaaatgggaaaaggcgtgcttgtcactcctaccgtacacggcaacctcttagtcggcccaaccgcagtggatgtcacgaataaggaagcagtcaacaccacacaggacggactggattccctcgcaaagactgctgctttgagcgtcaaaaatgttccgatgcgccaggttatcacctcatttgcaggtctgcgcgcacacgaagacggcaacgatttcatcattggggaagcggaagacgcgaaaggttttatcaacgcagccggcattgaatctccgggactctcctccgcaccggcaatcggagagatggtcgcaggtatcgccgctgatcttctttcccttacgaaaaaaacagattttatctccacaagaaaaggcatcttaagaccggagacactttccatggaggagcgcaatcagctgatcaaagagcatccggaatatggcaacatcatctgccgctgcgagatgatcagcgagggcgagatcatggacgccattcaccgtccgctcggtgcccgctccctcgacggagtaaaacgccgcacaagagccggcatggggcgctgtcaggcaggtttctgctccccgcgtaccatggagatcttagagcgagaagtaccaatgagtatgtttgatattaccaaaaacggcgtcggcggcaatatcgtcatcggcatcaacaaagagatttaaagggggattctactatgaaaaactatgatttagtcatcgtcggcggaggtcctgccggacttgcagccgctgtatccgcaagagaccacggcatcgagagcatcttaatcatcgagagagacaaagagctcggcggtatcttaaaccagtgcatccacaacggtttcggcttacataccttcaaggaggagctgaccggaccggaatacgcttcccgcttcatcgagcaggtggcagagcgcggcatcgagtacaaattaaataccatggtcatggacatcgctgccgatgccccgtccggaaacgtaatcacaaaaaaagtaaccgccatgaaccgcgaggacggcatgtttgagatccacacaaaagcggtcattctcgccatgggctgccgcgagcgttccagaggtgccttaaatattccgggctatcgtccggccggtattttttccgcaggtacggcacagcgtctggtcaacatggaaggctatatgccgggccgcgaagttgtcatcttaggttccggtgacattggtctgatcatggcacgccgcatgacgctggaaggcgcgaaggtcaaggtagttgccgaactgatgccttactccggcggtctgaagcgaaacatcgtacagtgtctggatgatttcggcatcccgttgaagctcagccacaccgtcatcgacattgagggcaaaaaccgtgtcgaggctgtcacgattgcagaagtcggtccggaccgcaaaccgattccgggaaccgaggagcgctacacctgcgacaccctgcttctctcctgcggactgatccctgagaacgaactgagccgcagcgcaggcgttgccatcaatcctgtcacctccggtccaatcgtcaatgacagcttagagaccagcatcgacggcgtgttcgcctgtggaaatgtccttcatgtacatgaccttgtggactatgtttcccaggaagcaaccgcagccgggaaaaatgccgccgcttatatccaaaacggctccagcaaagatgccgcatccgtcgagattttcccggtggacggcgtgcgctacaccgttccgaaatatgtccgtccgaccgagatggacgacactttaaccgtccgcttccgtgtgggcgcggtatacaagaactgctcgattgcgacttactttgatgacaccttaatcagcaagcgcaaacgtccggttatggctcccggcgagatggagcaggtaattctcgacaagaaaaaacttgctgaattcccggatctgtccagaatcacaatccgcattgaagaaaattcataaatagaatggaggaatcatcatgagcacaagagaattgacctgtatcggctgcccgctcgggtgcgccatcacagttaccatggacggatctaccgtcaccgccgtcaccggcaatacctgtccgagaggcgatgcctacgccagaaaggaagttacgaatccgacccgtatcgtaacatcgacggtccgggtgaacggaggcatctacccaatggcaaacgtgaaaacagcctccgacattccgaaaggcaggattttcgactgtgtcaacgccttaaaggatatcaccgtcaatgcaccgcttaagatcggcgatgtggtcttatccgacgttgccggaactggtgtcgacatcattgccgccagaaatgttcctgcaaaataagcgctttcaaagaatctcactttattatataataaggtcatcatgcgatcggcatgatgaccttattgattcaccgaatacaggagattgtcatgaagaaattatttaaagaagccctggaggattctcccatcattgcagcggtcaaagacgacgaaggtctttccagatgcctgaccagcgacagccgcattatctttatcttatacggcgacatcgtcaccatcagtgacatcgtggagaccgtcaaatccgccggaaagcttgcgatcgtccatctggatctcatcaacggactgagttccaaagaagtggcagtcgactttcttcaaaaatacacgaatgccgacggcattatcacaacgaagccgacacttatcaaacgcgccaaggagctggggctctttacaatcctccggctgtttctgattgactccatggcatacgagaacatcgaccgccaggtcaaatcctcccgcccggatctgatcgaaatcctgccggcactgatgcccaaggtcatcgccaaagtctgtcagtccacctccacaccggtcattgccggcgggctggtctccgaaaaggaagacatcctcgctcttttggatgcaggcgcgaccagtatctcctccacaaacgagaaaatctggtttttataagcactcctctcctgcatgtattatgatgcagtgccagacattctgtgctggatcatatgcgccaccagcaggattacaaaaatgcaggctgcgtttattcttcatattcgattcccccgcttcctgttttttcttccggaagtgtctttacaaagcaaaaaaagtagatgacatgacatacccacacaacggataaaacaatccgtccgacgggcacatttttcatacagataaatccgatcgccataagaagcgtcacagtggcgacaatactgaccttggttttcatctgcataccttcttttctcacataggattccagattctttttgtaaagatcggtaccggtaaaccagtcatgaaggcgcgttgaactttgtgaaaagcaaaaaagcgtcaacagaaaaaatggaaccgtcggcagaatcggaagcacaataccgatacagcccagcgcaaggctgatacacccggcggctgcgaaaaaatattttttaatcttcaatctctgactcctttgttatgttttgttggttagtcgtgactaatctgcaaaatcataccataagttgttccgcagtgcaagccttttttcaaaatccattttcgcttttcagctgctttttgcgagctgtgcaaaaaaaagaaccactaccttacggcaatggttctttcaacaattcatgggcagaggtggattcgaaccaccgaagcaatttgcagcagatttacagtctgtcccctttggccactcgggaatctgcccatttgtcaatgtgtcctgacagaggtaaattatatcacagcctaagcagatatgcaagttataaatttaaaaagtgtcacctattttcaataaatgcccggaaaaccaaaggctttccgggcgttgccgttcattcaggaaatcagagttttctacacatcaggattccctataacataccatccttgatcacatcatgatcccggagcagcttctccacgacggttcccttgaccacacgaagcagcggcttcttcaatacattgagcggtcccggcagttcgatctcaagcggagactttccatccatcagcttcacactgctgtcgagcagctctctgacatcatagacacttccccatacctcaggaacgcctctgtctacaccgagcagtccgtataccgcctccattgcggttctgaccgaatattccgtcgtgaagaccgtatcacgcggtgtgtccgcgaactgtccgaggaacgcaaagttcacacagccatccgggatgacgtccgggcggtcgcccttggttctcggcataaagaacgctgtgatgtacggcatcatcgtcggtacacatacggcgctgttctctgccagatccgggatctcctccaccggaacacccagatgatacagccactcctcggtgatctccttaccggtacactccttcatcggcttcttcacataatcgcccggcacatcggtgaacagaccgtatacccacacgcatactttatccttatcctgatccttgaactgtccctggcggttgatcgtccagctgagcagccagctggaatccttacagcttacgatacctccggtcacaacttttccgcttctcggatcacgcttgcagatattcgtgatgtacggaatgatcttgtcgtccaacgtggtcacggttgcagattcccagttcgtcttcgctacatccgagcagaacttctccggatgtccaaaagacggatcctgctttgcaatattcttccacaggctccagcagccgctcgtgcgcacttccgcgtccccgttcggcgcatggttctgatcaccgtaaatcgtaccctcggtacagcttccgtttgtcacgaacacgagatcattctccgtaagcacaatacctttctccacaccgttgaccttgcactcgagcgccttggcaaccttcttgtcatctttgatgtcgaaaatgacattcgttacctcggtgttaaactggaagtcaacaccggcttcctcaaggtatctctgcatcggcagaatcagcgactcatactgattgtacttcgtgaacttcaaagcgctgaaatccggcagtcccgcgatgtgatggatgaaacgctggaaatagagcttcatctccagtgcactgtgccagttctcaaaagcaaacatcgtgcgccagtacagccagaacgtagaattgaatacctcgtcgtcgaacacatcctcgatcgtcttgtcgtagagatcctcatcctttgtcatgaacagcttcatgatctccatgcagcccttctggctcagattgaacttgccgtctgtgtgcgcatccttgccgcgctcctctgtggcacggcacagggaatagttcgggtcttccttgttcagccagtaatactcgtccagaacggagacgcccggcgtctcaatcgacggaatgctgcggaacaaatcccacaggcactcaaaatggttctccatctcacgaccgccgcgcatcacatagcctctggtcggatcattgataccgtcgcaggcgcctcccgcgatgtccatcgcctcaagaatgtgaatgtgggaaccttccatctgaccgtctcttaccaggaagcaggctgctgccagagaggccagtccgcttccgacaatataggcgctcttctcatccacaccctccggctttctcggtctcgcaaaagcctcgtaattaccgttggtatagtaaatacccttgctgttcttctcatgcttgccgcgctcggtattgcggtattccgctctcgccttctcctcgattgctttcttctgcgcacgctcgctgctgttcttatggctgcctgccgccagtgccgccacacccgctccggctgccagcgcagccacgccaagtcctatatgttttccttttcccatcgtaactaccacctttccacttatgctgtaaattctttgtgtccttatcttagtctgcccagatgaatgacacaatttacaaaaagatcaaaatgataaaaaacttatcattccgtctcttttgataagcttgcggattgcttctgttcaaaattccgggcggcatttaagatactgccgtgcagcatcgtactcagccgctgcacaagctctctgtaatccgccttcataccgccgtcgatccagtgcagcatcatacctacaaagccgtatttgtagaactccgcaatcagtgccttgtcctccccgctgacagccgcatcgcggcattcttcctctaccacatctgcgagcagatcataggtcagcttatagagatagctctcgatcttcttctggctgaccgagtgataaacattcaaaataaacggcttgttctccaataccgcctcaaagatctgctccagtccttcactccacgtactgtaagttttcttatccgcaagtgcacgctttccgtcctccaggcacgcccactcaatcaggtcgtaaatatccttgaagtgatagtaaaacgccatgcggctgatcccgcagtcctccgtcagatcgttgatcgtaatcttatccaccggcttcttaagcaaaagctttttaagtgatgcctccagtgcaagttttgtcgtgttggacatggctgcctccctgttccgttcttgcggcaacggatcttaccgtccgcacctttattgtattcctcctcgcaggtatgggcaaataaagaatttctaaattttcttaattcttttttagccgttaatgcacgtttttgaccacctgcacatccaaattactatatacatttatgatctatttgttataatattattatatttgcgcttatggacaaattgggtggttttcacacatatttgaatgcgcaggcggaggaatacatgatcagcaacacggatatccgttacttttttgatacttactatgacaacttcatgcacagtctcgcctgggaggatcaccttctggagcctgccagccgtgaggaatggctggcaacgcttcgcgcatgtgcagacgaccagcagcagcgctgtgcggacaatcagatactgcttgagcagtatctctatccgctaagcagcaatcctgctcttctgtccgatgagggatatgatcttttactttctttttgccgtgatttttactacagcaactataccgaaccggctctgctgatccgcattattgatatcctgcttccacattatgaagaccgcagcgatacggaaagcctgctttttctctacatctgcgccggcttttcatacatggagctctcacgaaccggagagcccacctctcgtgataagactatatatttctacaccaaagtgctctcttaccgcgatcagattgaattctttgaatcagctgcaagccgcgactatatttttattgcctattacaatctgatccgggtggcgccgggtcttggcatcttagacattgagaccgcttaccggctctgggaggagctctgtcagatccgtaccatgcccaaattctgtcagtacgataccaccaatccacggattccgcagctctgtgactgtgcaatcaacgatttccgcgcgtacggcgctgttcttaacgttgaacgtgttattgcaccatccgcgatcctgtcctctctggagaatatgacgcagatctattactccgagatattgcacgagcatggttccatctatgagtgccctgcattcacagtatttaattaccactatgtgcaggcacgcaatggtacaatcacctgggaagccgcctggcagatcctggacgattattatgtccacaagatgcagaccatcggtcaggtttcctcgcctgacctgcttgctttttataccaatctgccgctcaacctgatcgacgtgctggggcatacgcatttcaaggaagagtttaagcaggcaacttaccggcgctaccgcaatctgattaccagctatctgatgaatcagcctgccagtctcaattcctacacgttaaacaacggtgtccagctggtggcgtttcacccgctgatcctcgggactttccagaaccgtatggaaaaaatgaactttatcgtagatctggtcgtaaccagacatctcacgacattcacacactccgttatggtttcctatcttgcagaagcgatcggaaagcatattttagccgcacggccggagcttttgcggattccgtcctcctatctggagggaaatgtctatgcctcccccgcggaagtactggactatatcgttcccgcagctttattccacgatattgggaaaaacggcatgatcccgatcatcaacacgcagcaccgcaagttaaatgactacgaatttaacattattcagacacatccgcagaagggctccgactatctgtcgtccgatccggactttttaatctaccagccggttgcgctcggacatcaccgctcctacgacggtacccgcggttatccgctcagttttgacaataccgcctcgccgtaccgggacgccatcgacctgatccacatctgtgactgtctggatgcagcgaccgattacttaagccgcaattaccaccgcgcgaaaccgttcgatgtggtattgaacgaactgaaagcagggcgcggcaccgagtacaatcctgatatggtggatgtgattctaagcgaccgggaattatataacgatttaaagatgcttacggagcagaaccgtgaaaatatctactatgatatctatctcacgtttgtgaatctccgcaagaaaagacaataaatgggatacgttttattatgagaatatcagaaaatatgaagttccagaatgtaaccggggcggcaattctttgaagcaaaatccgaggatttcttccgtgctgcgtcgggcatcgggttctgtgtctttccaagtttggacagtccccgtggtgtgtccggcaaaaccgcagacaatgagcggactttctggtgcccctagtggcaccgcttcacagacaatataaaaccgcgcgaaccgaactcgttatcatctgctattgaaaacagggcagatgacaactcagacagcggcttcgcgcggttatgttctgtttgctggtgccacgaaggggcacgcacaaaagtccttaaattgtctgtggtttgcggacacaccacgaggaatgttccaaacttggaaaaacacagatgatcagggatgtccgacgcggcatggttagaaatactggattttgcgattagaattgccgcccccggttgcatctggaacgtgatagtctctgtttcttataataaaacatatcccatttcaaatatttttattagaaggtaaaaaaaagacagcctgtcgaactgctgtctttttaggagaaggtatttttactatggggtatagcaaaaactatatataatgtattggggggtttttacggttattataatagcatgccccgccagataagtgtgcacaaacttcacaattttgtgtgcacgtttttattcattttgtatagtaccttctgcccggtttttcttttttcattgccgttatgcacaattactgctcaaacaattcctcaaactcctgctggctgattttttccttctccagcagaagattcgcgcaggcatccagcacgtcgcggtgctccgcaatcatctgcttcgctttttcataacattcgtcaatgatccgcttcacttccaggtcaatggtggtcgcaacgccctctccatagcctctcgtgtgcgccaggtctctgccgataaatacctcatcgtcgtcattgtcgtagcagatcagaccaatgttctctgacattccgtattttgtgaccatatcctttgccatccgggtcgcctgcttgatgtcctgagatgcccctgtcgtgatgtcatcaaatacaagttcctccgccacacgtcctcccagagatacgataatatcctgcagcatcttgcctttcgtgttgaacatgtcgtcacgctccggcagcggcatcgtgtaaccggcagctcccgctcccgtcggaatgatcgatacggaatagaccggaccgacatccggaagcagatggaacagaatcgcatgaccggattcgtggaatgcggtgatacgcttttccttctcggagatcacgcggctctttttctccgcgccgattcccaccttcacaaacgccttcttgatgtccgcctgtgtaatatacgcacggtcttccttcgctgcgataatagccgcctcattcagaagattctcaagatccgcgccggtaaagcccgcagtcgtctgtgcgatctgttttaagtcgacatcatccccgagcggcttgttcttcgcatgaacggaaagaatctcctctcttccgccgacatccggacgtcccacatgcaccttccggtcgaaacgtcccggacgcatgatcgccgggtccaaaatatccacacggttcgtcgccgccataacgataattccctcattgacaccgaaaccgtccatctcaacgagcatctggttcaatgtctgctcgcgctcatcgtgaccgccgcccataccggtaccacgccgtcttgcgacagcatcgatctcatcgataaacacgatacacggcgcatttttcttggcttcctcaaacagatcacggacacgcgaagcgccgacgccaacaaacatctccacaaaatccgaaccggaaatactaaagaacggcacgcctgcctcaccggcaatcgcctttgccagaagtgtcttaccggttcccggaggtcccacgagaagaacaccctttggaatacgcgcgccaagcttggtatacttcttcggggcacgcaggaaatccacgatctcctcaagctcttccttttcctctttcagacctgccacattggcaaatgtcacccgctttgccgggtcatctgtcatgagctttgcgcggctcttgccgaagttcatcatcttaccgccgccgccggaattggcagccgcctgattggtcataatcatgaagaaaatgaacatcgccgcaaaaataatcagatacggaagtatcgtcacgatccagctctgctccggcggattctccacggtgtaagacgtaaactgctgatcgcgcagataatcttctatatcatttacatcgtttaccgccagaacctgtgtcgaggagtccttaaatgtaatgtatacattaccggtcggcacctcgccgcggttcggtacaatcttcagctgtgcaacatttccatctgcaaccgcagtctcaaactgtgcccgcgtgtaactgttggttgacgtgtttccgtccatccaataccagatacctatgatggcaagtatcaggagcagatagatgccaaatcctctgtaactgcttctcttactattcaatcgatttctcctttattcctctatctcaacaaatccgatatacggcagattgcggtacttctggtcatagtcgagaccgtatcctaccacaaattcatccggaatgacaaatcccacataatccacattgacatccaccactctccggtccggcttatccagaagcgtacacagtctgagtgtcttcggatttcttgtcttcaaattctccaacaaatagcttaaagttctgccggaatcgatgatgtcctcaattaccagcacattcttgccttcaatactggttccaagatcatttacgatacgcaccacgccgctggaacttgtgcctgatccatagctggataccgacataaactctatctcaaccggtgaagtaatacgctttgccagttcgcaggtaaaaaataccgatcccttcaaaatacagatcagacataccggctcatctccgtacaccttgctgatctcggctcccaactctcttactctctgctcaatctgttcctctgtgagatgaacgttaattttcttgatcttcacaatcgtttcctccacttaaccgtacttctaatatcttttctgtattctctccgactttgcagccggcgccgatgcgcccgcctgccacccacaggatctcggatcccgttgccagaagccatatagcgtctctcttcgccgccggaatcttctcattgacaaaatattccttcagcttcttggtatgtccggcagcatctatcatcaggtaatcgccgctctctcttctgcgcagccgcagaccagattttattttaccataatcaaaccatttcgtatatgtttttttcgggatttcctgcatattccccgaaaaatcacgtatccgcaggtgcagtctgccatccggcagcgcaagcaccacctcttccttttctgcgcgcgaaagcatctccccggtaacctcaatgctctcccgttccatatcaaccgccggctcttccctgtacagccggattccctcatacacacgctccgcacgcacgccgtagggcaggcagatcacacggccgacctgtcttgtatacagtgtgcacagttcttctacatgcacacttccgatgtcacggttgctgcccgccactttttgcagcgtcacaagcagtacttcccggattaaaagtgcgggatattctgaaaaaagaaccgcatcgatcacacaggcatccggggtgtcacggcacacacgctccgtcgcccggcgcgtctcttcctccaggtaatccgacaattccattaacatctgtgcgctctgcatcatatgatgcaccgcccccgtattcaccgcttttaattccggcatcaccttatggcgaatccggtttctgctgtagtcggtatcctcattggtcgcatcccggcagtaaggctgtccctgtgccttaagatacgcctcgatctccgctctctccattccaagcagcggacggatcaccgtgacaccctccgcgagcctgcgcgccgggcgcataccgtagagtccgtggattccgctcccccggatcagccggaacagcatggtctccgcattatcatccgcatgatgcgcgagcgcgatcttcaccggtctgccgtcatagtcctctgctgcctccctgaagcactcatagcggagcttcctcgccgcctcctcaacgccgaggccgtgtcccttggcatacgccgggacatccaccggataaatcctgcagcaaacgccccgcttttcgcaaagccttttaacaaacgcggcgtctctcctgctggcctctccccggatcccgtgttccacgtgcaccgcctccaggagaaaatcgcagtgcttccggtactcaagcagcataagcagcagacataccgagtccgctcctccggagacgcccgcaagcaccacatccccggatttaacaagcccctccagttccattcctttcttctgcatcgcatttcctctatcgtttcacattctattctatgcctttttccagatgcacgccgcaagtaccgtcatatcgtcctgtgcgcgcccgccggtaaaaagcatcactctgtccataatcttttttgccagaattcccggattgttggttttgatactgagaatcatttcccgcatcgtctcctccggcttcggaacatgtaagtattctaacacaccatccgtcaccatgacaataaaatcaccgtcgttcagctgtatctccctcggttttgcatccaggtgcgcacgcgcccccaccggcagattttccgatgcaatgcactccacctcatcctcccgccggataaatgcagccgccgctcccaccttgtacaggcgtgccataccgctgtacaggttcaccatgcagaggtctaacgtggagtagatgtcattttcccctttcatcaccatcgccgaattcatcatgcgtattgccgtctccagggaaaaccctgcttccagaaaacgttccacaagatccagcaccatctcgctctccttgcaggcactgctcccggagcccatgccgtccgacagtccaagcagcatttcccctcgctcgagttccagaaaagaaaagttgtcgcctgaaatttttgcctcatccttcttcacccgcgcaattccctgcacgctccggtatgcggtgtcctcgtagatcaggaaccggaacggctcctttgcaataaacgtccgcgcatccgcggttgtccggagcttttttccaagcacggcgccggagagcgtcagaaatgtcttcaccgcgacacagcctcccagccggctttttagcactgcgtcaatccggatccttccgtccaccgcctcgatcaggtgcagttcttccaccacaatcccctgctccttcgcacggtattgaatctccgagaggacatggcgttcccccacgtccagaattttttcctccctggcgcagtcctgcatgatatacgccatcgcatccagctgttccgctatcacctcccggttctccaccagtctctggtaccatgcccggtttaagctgacgcgctcaaagacgcgcaccgcctcctccaccatatcgctgctgtgcctgcaatactgtacaagctcctgctttttctcctccccgggagtctctccgttccagatcgcggaaaggatccccgacagcgcgccgtataagggtgcaggatctctctcccagcagactgcacacgcgtcacacgacgcgcagatctttccagtcagctcgttctgtatctgtcccagttcctccgccgcaccgttctgatgtgcggcactcatactgtgaaaaacctgggacaagccctgaaacgattccgcataccccagcagccgctcctctcttcctccatccggccgctccggcacccccgcctttcttccccagtgtaatatcatatgcagggcacggttaaaaagaatcacggctcccaatataaacgcgccctccagcgccgccgccagaattccgggctgatccttccattcaagaagtccccccgccaccgacaggatcatggtaataatcgctgccatactgcccgccatataggaggggcatccctcgttggcccattccacgagccggattgctcccatcaccacgacaagcgccaccgcatactttactgctgccgccgtcggcataaacacaaacattcctatgtacatcataccgagcagcaccggcccgctgacccgctccagatacagcgccgcaaaatacgccggcaccagagggtaacaccccatcacgcccacactgcacattacacttcccgccatacagagcatcatttgtcttgcattcatttttttcatcgcctacctccattcccgcctccggtctgtcccggtgtttttcgcgggtgacatcgattatagggttgttcccggaaaatctttgtcaaaggaaggaccccttttgaaaaacttttcgccaaaatatcggttccattgtctgtttcatggactttgaagcgcttcgtgccttttaggaagttcatccagaaatattcctctaccacattttttcatgccggtgttataatgtacgcaaaagcatagccaccatgatatgaaaggagattttcttatgggttatatggcaaaagaaagccgctatgataccatgcagtacaatcgctgcggcgccagcggtttaaagcttccaatggtttctctcggtttctggcacaattttggggacaccggacattatgacaacatgaaggcaatgtgccgcaccgcttttgataacggtatcacgcattttgatcttgcgaacaattacggtcccgcttacggcagcgcagagcgcaacctgggacaaatcctgcgggacgacttttctgcgtaccgggacgagcttctaatcagcaccaaagccggctacgatatgtggccgggaccttacggcaactggggcagccgcaagtacctcatcgcaagcctggacgccagcttaaagcgcctggggctggattatgtggatattttttatcatcaccgcatggatcctgagacaccgctcgaagagacgatgggcgctctcgattccattgtcaaaagcggaaaggcactctatgtcggtctgtccaactatgacggtccgacactggaacgtgcatgtgcgattctaaacgacttgaagtgcccgtttatcatcaaccagaaccgctactccatctttgaccgcacgatcgagaaaaacggtttgaaagatactgccagaaggctgcaaagaggcattatcgccttttcaccgctggcacagggcatgctcaccgaccgctatttaaacggtattccggctgacagccgcatcgcgaccgacggacgtttcctcaaggagaccgcacttacgccggagcgtctctcacagatccgcgctctcaatgagcttgccaaaaagcgtggacagacgctcgcggagatggcattaagctggatcttaaaggacggtgacgtgaccagcgtgctgattggtgcttcccgcccggaacagattctcgacaatatcgccattgtcggacatacttcctttacgccagaagaactcgacgcgatcgatcagattacactttaacagccaaaaaagaagccttatccgggatgatctctccgggtaaggctccttttattctgtcattcttatgttcttaaggttcttccttaaatataatctcattgtcataggctagtcccagtttgctcttcgcaatatcctccacatactcctgggactgtgtataggactggtaattctgaagttcctcctgccttgccgtctcatcctgaagctgcacctccagctgttcctgctttctggcgtactcctgatctttctgataagcttttacaatctggacagacattgccgctgcaaatacaaccagaatcatgctgatacagatcttgcccgccctgttattccgatttgattttctcttctttgctgccattcctgtccctcatttcctgcatctgtgtagcaatttacagtttacataaacctattttaaccgctctcacaaactttttcaatcgttttccacaaaatgccccaactttttttaaggttttccacaccggacgcacgaaaaatcccagcacttttccaataattcccagtatttttttccagatccacacctgacagtgcacgatcaggcggctgagcagcagataataacacgccattccgaccagcagaccgccaaacgcaaacccgcgcaccatgccgtcattttcccggtataaaaggacaaagaccacgcctgtaaaaatgatccagtacagaaaatcctccacgccgatccagatatttccgtgcggaagaatccggcggaaaatgcgcaggatatcatagagaaagaaaagtcccattcctaccagcacagagctcccgagaaacagcagttcctgatagattgatgtgcttaccgccatctaccggaacagccttcccagaagagattccgcctgttttcccgccgttttgacatccgaataggtcagggaatcaatccgtccctcaatatccacttcccctttttccaggctcagtcggttcacgtgcagatcctgtcccttgatgagcagcatccccagttccgtctcgagcagaatctccgccacatcaaaagacagcacatccacaacaccggaaaacgcgccgtttccccggtttaccagcaggaccttatgtgattttgccgtattattataattcttttcctccataaaaaaacctcccgctttccttttctattagaaagtatatgggaggtttttcatattatgatacatattcaaacaaatccttggcttcttcctttttcgtcgtatcctgcagatccagcacgcgaactttcacggtcttcgttccaaaaccgatctcaataatgtcgccgacttttacattcacggaagccttcgccggtttgccgttgaccatcacacggccggcgtcacaagcttcattcgccactgtgcgtctcttgatcagccgggacacttttaaaaatttatccagtctcatcttcttctccttatgcctgcggagcgttcctgcttccaaaggctccttttccttgaaagcaaaaaagtggattctgcaaccgcaaaatccactctgctatctctatatcacttaggcgttgatcatatcctttaaagccttaccagccttgaacttcggagccttggaagctgcgattgtcatctctttaccagtctgcggatttcttcctgttctctctgctctctcagatacctcaaatgtaccgaatcctactaactggatcttctcacccttctttaattcctcagcaacaacatctgtaaatgcctttaatgctgcctctgcgtccttcttgcttaactcagtcttctcagccattgctgcaactaactctgctttgttcatgttaaaaattcctcctctggattttcaatataaataatattcgaggttctcaaaatacctacttcatatttatacttgttttttctttctttgtcaagaaaaatccccaaaatatggggattttccgagcttttttacgtttgggaagcgtttacatcatggtgtcgatcaatgcgtgaaccgcttttgagagcgcttctgattttgcgtccgcatccgcgagcgatgtcccctttacgccgagataaaatttgactttcggttcggttccggacggtctgacgcacacccatgccccgtcggtcatctcgtaataaagaacattcgacttcggcagacctgtcggccgcactgcacccgctgccgtatccgtgatggtgtccagcttataatcccgcaccgccgtcactttgtatccaccgatctctgccggagcattttcacggagcgtattcataatctcctggatcttcgccagtccttcgattccctttaatgtgatggaagtcacatcatccttgtagtagccataacgctcatacatggcaagcattgcatcccagagtgtcatgttcttcgtcttatagtaagccgccgcctcgcacagcatcatcgatgctgcaacggcatccttatctctcgcgtaagttcccggcaggcagccatagctctcctccataccaaagaggtatgtgccctttcctgtctcctcaaactctaaaatcttctgtccgataaacttaaatccggtcagcacctcgatcagatctatttcgtagtatgccgcaatcgcatctgccatattcgtggatacgatcgaacggataaatgcgccgtcctccggcagtccgaagagctccttgcgctgtccgatcacatagtcgccaatcaggcatccggacatatttccggtcaggctgtggtattctccggtctgtgcatccttcacataaacacccagacgatccgcgtccggatctgtcgcaagaatcaggtcggcatctacttttttgcccagtgcaagtcctaatgcaaatgcctctgccgcctccggattcggatagcttaccgtcgggaaatcgccgtccggcagttcctgctccggcacaacgtagacattcgtgaatccaagctctttgagcacacggcgtaccggaaggttgccggttccgtgaagcggtgtgtatacaatctttaactcggatgcaactttgtcaatgcagtcctgatgaagcaccagttttttcagttccgcaatatacggatcgtcaatatccgcaccgatcgtctgatacagaccgtctgcctttgcctcttcaagcggcatcgtcttcacagaagcataatccgtcacgtttctcacttcatccataatccctgtgtcatgcggaggtgtgatctgcgcgccgtcctcccagtatactttgtatccattgtattccggcggattatggcttgccgtgatgttgatgcccgccgtacagccaagcttgcgcaccgcataggaaagctccggcgtcggtcttaacgattcaaatacatatgccttaatgccgttcgctgcaagacaaagcgccgcctcgtcggcgaactccggggacatatgtctggaatcatacgcgatggcaacaccttttgcctgtgctcccactttgcagatataattcgccagtccctgtgtcgctttgcgcaccgtgtagatattcatgcggttggttcccgctccgatcacgccgcgcagtccggcagtaccgaactccagatccatgtaaaagcgctcttcaatctccttctcattcccagcgatcgcctgaagctccgctctggtcgcctcgtcaaaatacggattgttcagccatgactcatatgtttctctatatcccatctcagattcctcctgctttttttctaagcctatcttatctttcctgttttgctttttcaagtaccattcctgtcataaattgatacaattctctcaattatttcccttaagcgcattgagcagggacgtaagggtggaaagataatccgaagtgctgctactgttggaactgctgctggagctgtctccattcttgtccagaatctcgtttacgatggcatccagcgcagcgtcactcgtcgtgtccgatgttcccgtcgatgtagaagacgaacttgaagatgaacccgaggaactgctgtccgagtgacttcctgccaggcttcccgcgagacttcccgcctgtccgtctgcgctctctcctgtggatgtactgctgtctgcctccgatgactgcgtctcacttccggtcgtagtcgacgagcttcccgattctcctgtcattccgatggcgatcgttgcctccggtgaattcacaaacagctttttgctgtatgtatcataaccgtccgccgtcacggtgagcgtatgcactccatactgtagttccaccggctggctgtaatccaccagctgcccgtctacctgaagccatgcgccctcaacattgactgcgaagagaatgcttccgtacttcggtccctcgccctttaacgtctcaagatccagaaccgtctcctgacctctcgtgatcgtaatctccgtacttccgccgtatccgttattcgcgacagctgccgtgtatgttccctcaggaatctcaatcgtcatctctccggtaatctgggcaaacaccttgcttcccacctgaatgtaacttccatcaaagacactggtattgaccagctttaacgaaccgtgcccggtggtcaccgagatggaatatattttcttgtcaattccgaccacccgaagcgtatccagtgccgtcagatctgaaagctggaggggacttccgtccgaaaccacaaacagatcctcatcatacgaataatttgtatccgcaatcttaaatgcaccgtgctcctcatctacactgtatctggtcacatccgggtattcccacgccagatcggagatctgcgcttccacaagcctgccctgcttatctttttccccgacacggataatgcgacccgcgtcaaatccagacaccggcatccggctgccatatttgtcaaggaaccgggtagcaatcgtgtaattatacatatactgcttgccggagttcaactgtgttaaaatcagacactccgcctgcatatcattgttagtgattaaaaacaggtctgctccgatcgacgtgccttcctgctccgtcccctgttccattgcatccagcacgtcgttcgcatccgcctccgtcccgacggtctgtgctgtgttttccgcatcctttgacggattatagtaagttcctgtcacaactgtattgctgctttttccgcatcctgccagtaacagcatcatgcagaccggcaggatccatcgaactattttcttcttcaagtatatctgctcctttatcgtgtacacaattctacggcaaaagtaccgccagattgattatatcctcttttttgcgctgctttctgcgcatccgaagttccaccggaacttctaatatgaatctgtcaagattcattatatcatattaaacaactcagcggaacttttatctcaggacgcgggcggctgcaaggtgaaatggcgcatcatttccaggaatcgttcccgctcatcctcctgccgtatgaatttttccagcttttcaatattgcgtccggacacccatgccttgtgtgtgttatagtagcggttcgcaattttccagaatttttccggatatgccatatacagatacagatagtttagttccacggcagtcagccggcgcacatggtcatacgcacagatgagatccatgccaagtccggtgttccagttgtttttttccagcattttccgcatgtagttcgccagatcgctgacctgtatctggtaggaaaagcactcaaaatggacaatgccgattccggttttggaaaacagaatattgtgctggttataatcgccgtgacaaaacccggcgctctgcccgccctgtcccatcgccgaaagttcctgtgccacctgccttgctttttccataaagcgctcatactgcccgtaaaagagcacttcaaaatcattctttttcttcttggaccgtatgtaattccggactttgaccagttcccggttatgcttctcatacagttcctgcagttcattcgggtcgttgcagacaaactccggaaccgtctccgaataagtttccgccgcattgtgcagcattgccagtttctccgcccccgcgatcatgtccgcccggtttctggtgtcacactcgctcccggaaacagccgtcaataccatatactttgtctcatcctccgcgacggcaatcggggcgtcctccttcgtccgcacgacctgctccgttaagagtccctgtccacccagatgcccgagtatggcagagagaaactctgcccgctccgccgagcctttgtattcttttaaaagtaactgcccctgtgttgtatcacaaatataactttcacgccctttggaaaccgctctcacttccaggtcgtactgctccaatacctgctccggtcgattatacacaaaaacccctccatatgattgatctgcggctgctctgccgtgtctcttcatcatatgtgaggggtttttatttcatgacctgttttgatcagaaatctttcctgtcacaatttttaataattgttccttcgtattcagcccgggatcttccagtacccgttccagcagttcattcagcatctccccgatctgctttcccggctgcattccggctgcaatcagatcctgaccggaaaccgccagttgccggatcgtaagacactcttttttctccatgcactcccgatacagctgttcatatgcgtccacatacgccagcttttccgcgcgccggtacccgctctgcgccagaatatccgcgcgcttgaccgcaaacaatgccggatactgttccacgccgatcctgtgcaccgccctgcggaccgccttcccggaaagctccggattatcatcgtgccagtgcaccagccggcacacccggtcggtggtatcgttgtcgaacttcagccggcgcagaattccacgcgccatctcgcttccgcgcaccggatgtccgtaaaaatgatccacaccttttttgtccgtcgtcctgcaggcaggctttgcaatgtcatgcagcagcatcgtaagccggagcaccttatccgccggcaccgcttcgatcgcctttagcgtatgttctcccacactgcagcagtgatgcggattgttctgcggcgtctccatcatcacgtcaaactccggcagaaaaacagccgtaagtcccatgcgatatgccactttcagctctcccggattcggcgaagtcaaaagctttaccagttcgacctgaatccgttccgcactgaccttttttatattgcccgccagtccggcaatggcttcctgtgtctcctgttcaatcgaaaaaccaagctgcgccgcaaaacggaccgcccggagcatgcgaagggcatcctccgaaaaccgctccatggcatttcccacacagcggatcacgcctctctccagatcgccgattccgtcaaaggcatccaccagtccggtcacttcattgtaggccatcgcattgatcgtaaaatcgcggcgtttcagatcctccagaagattcgcggtaaacgctacttcctttggatgcctcgcatcctcgtattctccgtcaatccggtaggttgtgacctcgaatccctcatgctccagcatgaccgtcaccgtcccatgctggatcccggtatcaatcgtgtgccggaaaagagccttgacctgctccggtctcgccgaggtcgtaatgtcccagtcctgcggcgttctcccgagcagggaatcgcgcacgcagcctccgaccgcatacgcttcatatccgtgctcgcctaaggtattcagaatcctcgcaaccttcgcaggcaggctgatctttgcatttttatccacgcacttctccttaatatgccttgccccagtataccagcttgtgcgccggtctgccgcagcatacgcaggttccggaaatctgctcctgatcatggaacgggatacagcgggatgtcacggcaagctcctctttgatcttgtcctcgcacgcctgatcctcgcaccacataccgcggataaatcccggtttgtttgccgcgatgtcctttaattcttcataattgtgggcatcccagatatgcgcgtcgcggtgtgcctttgcacgctcgaacatctctttctggatagtctctaaaatctccggaatcttctgctccagatcctccagtgcgacctcgatcttctctctggtatctctgcgcactaccacgcacttgcctgcctcgatgtccttcggtccaagttcgatacgaaccggaattccgcgcatctcctgctcggagaacttccagcccgggctcttgtccgagtcatccagcttcgcgcggcatacttttccaaggcgctcgcagacgctctttgcagcatccatgacgccgtctttgtactgctggatcggaatcaccatcgcctgtaccggtgcaattctcggcggcagaaccagacccgaatcatcgccgtgtaccatgatgatcgcaccgataagacgtgtggtcataccccaggaagtctgatgtacatactgaagcttattatctttatcggtatactggacaccgaacgcctttgcgaatccgtcgccgaagttatggctggtaccggactgcagtgcctttccgtcatgcatcagcgcctcaatcgtataggtagcctccgcgcccgcaaacttctccttctcggtcttgcgtccgcggatgaccggcattgccagtacctcctcgcagaagtccgcgtacagattcaacatctggatcgtgcgctgctcggcttcctctgcggtcgcatgcgcggtgtgtccctcctgccacaggaattccctggaacggaggaacggtctcgtctccttctcccagcgtactaccgagcaccactgattgtataccttcggaaggtcacggtaggagtgaataatatttttataaaaatcgcagaacagcgtctcagatgtaggtctgacacagagacgctccggcaacgggttcaatccgccgtaggttacccatgcaacctccggtgcaaatccctccacgtgatccttctctttttcgagcaggctctccggaataaaaagcggcatgtatacattctccacgccggtctctttgaatctgcggtcaagctctttctggatattctcccagatcgcatagcctgccggacggatgatcatacatccctttaccgcggaataatcgatcagctccgccttttttaccacgtccgtgtaccattgtgcgaaatcaacatccatcgatgtgatcgcttctactaatttcttgttgtcctttgccatcatctatctccttttcatagctcttactgccgttgcaagcagcttcaaggttgtctgtgtgcagctcctgcacaactaatgattttatgataaatggaaagggttgtcaatttcaaacgcaagatttctgcgtgttttcgggtgtctgaacccgattttgtacgaacagaggcagagcggttcccccgacggcttcatattctctttaaaattgtacttccggtctcccacaatcggcatccctgcatgtgccagctgcacgcggatctgatgatgtctgccggttcccagctgaatccgaagaacggcgcgcccgtttttctgctctaaaacctcgtaggaaagctctgccctctttgctcccggcgtactactttctacaaccgcagacgtattggttctgccgtcacgcagaagataatctgtaaactgcccctttccggcttccggcaccccgtctgtcacggcatagtaaaacttgtccgccagccccgacgcaatctgccggctgagtgcggccgccgactccttcgtctttgcgaacaccatcacgccgcataccggctgatccagccggtgcaccactccgatgtacggcggctcgcccttccccgcccgcctgtttttgagcaggctctccatatccgcctgtccgagccttttcgtctgtactgccacgcctgccggcttttcacagacaatgatctgctcatcttcaaataaaattctgatctccatattctaaaccgcatccaccatagtctgtgcccactggcgtgcatccgcaaaatctttctcatccggatgtgaaagcgcctcgtcaaaattttttacgctcgcattcaacttctgatcttctgggtgctcccgcagcatcgccacatagcggtttctcactccgatcggcattttcccctggcagtaaaagcttccgagcacctcactggtatccggaacgcactccgttacccggcacgccagcttctgatagtattctctggagccaccataaccggcagtgccgaaaaccgccagtttttttccttccagctgcttcaaatactcaccaaccgttccatcacagcttcccttgtccgtccaggatcctacaaaataaagatccgccacaatgtccggcttcggctcaccgaagtatacaatctcttcaccgccaagcgcatcccgtattgcttctgccacctgtctggtattccctgtcagacttttgtatatgattgcaatttttttcccactcatctgtgctctccttcgcccgctctgtcatcctactgcctatgatctctttaccggtctgccgtcgatacatccggtaaaatctgcttcgcgcgcagactcctcgcccggaagcggcgtatttctctgcccgccgctcttagagcactcttggcaggtgtccgaacccgcgtttgcttcctttctgccaaatcgacagacagtttcttccggtcccgacgaattatctgtcgaaccgccgctcgccagatatacgccctccgcatactcttttgtctccacaacttctggttttacatactttttcattttcctgcactccttccaaattataaattacagcttaaaccggtaccctactccccagattgttgctgcttcgcagcgcaggcgctcatttcagtacagcttcgctgtggagcgcctgccttgcacgcctttacacatccttacgatttaagctctacagcttaaatctgtaccctactccccagattgttgctgcttcgcagcgcaggcgctcattccggtacagcttcgctgtggagcgcctgccttgcacacctttacacatccttacgatttaagctatacagcttaaatctgtaccctactccccagattgttactgcttcgcagcgcaggcgctcatttcagtacagcttcgctgtggagcgcctgccttgcacacctttacacatccttacgatttaagctctacagcttaaatctgtaccctactccccagattgtttctatgtactgcggtttgttggtgttcatctcgatcttttcgcggatctttttgatgtgtaccgtcaccgtcgcaatgtccccgatggattccatatcccagatctggcggaacagttcttccttcgtaaatacatgattcggattctccgcaagaaatgtcagtaggtcaaactcctttgtcgtgaactgcttctcctcgccattgacccagacacgtctcgccgtcttatcgatgcggattccacggatctcgaccgtatcattctcaggcgtattgctaccgatcagccgctcatagcgcgccagatgtgccttcacgcgcgccaccagctcgctcggcgaaaatggcttggtaatatagtcatccgctcccagtcccaggccgcgaattttatcgatgtcatccttcttcgccgacaccatcagaatcggcgtgtttttctcctcccggatctgcttacagatctcaaaaccgtcaatgcccgggagcatcagatccaggatgtacatatcaaaatcttccgtcaacgcccgtttcaggccgacggttccgtcattctctatctccacctcaaatccgctgagttccagataatccttctcaaggtctgcaatctccacctcatcctcaatgatcaatactctgctcatatggcacctcctgatattttcgtaatacaaaatacatcacggttccgatggactccttgcttgtcgcccagatcttaccgccgtggtcttcaataatcttcttcacaatcgataatccgataccgctgcctcccgtcgcagaattgcgcgacgcatccgcacggtaaaaccggtcaaaaatgtaaggcagatcgcgcgcggcaattcctctgccgttatcttcaatctcgacctggataaaatcaccgacatccttgatccggatattgataaatcccttctgcttgtccagatatttgaccgaattccccacgatattgttaaccacgcgctttagctgctccgggtctgcaataatctggacatcctcgtccgcataattaaaatatgccagtccgatgtttttcgcctcgagatcgagcccgatctcctcaatgcagtcattgaaatactccgccacattcagctttgcaaaattgtacggaatgcggttggtatcgatcttcgcatacaatgtcagttcattgatgagcgtatccatctcattcgccttattataaatcgtccggatgtacttgtcacgcttttccggtgtatccgccacaccgtcgataagtccctccgcataccccttcacagctgtgatcggcgtctttaaatcatgggcaatattgctgatcagcgccttgttctcacgctcaccggaaagcttttcctctgcgttatccttcagccgctgccgcatctcctcgaaattgcggcagagctccccgatctcgtcattcgtctccacatccaccgtaaaatccagattaccgtccttaatgttctgcgccgccacctgcagcttcttgatcgggttgataaaactcgtataaatccatacggtcagcatacatgctgtcaggattaagatcaggataatcgagatccccacatccgccatcaggctcttcaactccggcacggtctcctcgaggatcgtgataataaaaacactgccctggcttccgtccgtatacacaaaatcaatctgcttgatcagcgcctgcttgtctccgtcgacatagatgccggtgtctgccccggactcttcccctccgtaggccggcagatccgtcagcagcgacgcctccttatcatctcccacatagatcagctcgtctcccctgcgcacgacaagatacgaatacttctcgcgcagagtgtcattcatctgctccagaaacgccttatcctccagcttatccggatcctgctttgaaagatccagaagcgtctcaaaggactcgcgcgtaaaacggctgagcagctgcatggaattagaaaaataactgtaatcgtcactctccacgccgtatgtctgttcaatcgacttcagctggatcttctggaatccgaaaagcaccgccaccgcaagaagaatggggataaatatgataatacaaaatgaaatgataattttatttttgaacttcatgtctgctttgtccaccccgcaaattcccgcaaaaaaacgggtcatagaactgtaattctatgacccattataacacgaaacatccaaaaacctatttattttatgtaaaattgtctaaacttttcataaaactctacaaatatttctttaatgtctccaccttatcgactgcctcccacggaaggttcagatcggcgcgtccaaaatgtccgtatgccgctgtctgacggtaaatcggtcttcttagatccagcatcttgatgattcctgccggacggagatcgaagttttcacgaacgatttccaccagtttctcgtcagaaagctttccggttccgaaggtgtctaccataaccgatgtcggctgggcaacaccgatcgcataggaaagctgaatctcgcatttttctgcaagacctgcggcaacgatgttctttgccacataacgtgccgcgtaagctgcggagcggtctaccttggtgcagtccttaccggaaaaagcgccgccgccgtgacgtgcatatccgccgtaggtgtctacgataatcttacgcccagtcagacctgcatctccgtgcggtccgccgataacaaaacgtccggtcgggttgatgaagaactttgtctgtgcatctaccagttccttcggcaggatcggatcaaacacgtatttcttgatatcctcatggatctgctcctgtgtaacatcatcatcatgctgtgtggacagtacgacagcttccagacgaagcggctttccattctcatcatactcaacggaaacctgtgtctttccgtccggtctcagataggaaagtgtgccgtccttgcgcaccctggtcagctgtaatgccagcttgtgtgcgagagaaatcggatacggcataagctccggtgtctcgtttgtcgcataaccgaacatcataccctgatctcctgcaccggtatccagttcatcctttaacccgccctcttttgcctcgagtgccttgtctacacccatggcaatatccggtgactgctgatcgagcgctaccataactgcacatgtatttccgtcaaatccggtcttcgcatcgttgtaaccgatctcgttgactgtctgtctcacgatcgccggaatatccagctttgcctttgtggtaatctctccggttaccagtacaaatccggtacagcttgccgtctcacaagccacacggctcattggatcctctgccatgcacgcatccagaatcgcgtcggaaattgcatcgcagactttgtccgggtgtccttctgtgacggactcagatgtaaataatctcttttccattccttattactccctttctcatcatgtaaaatgacacaaaaaaaccacttgcgaaaaacaagtggaagtgacgtatagataatcaaatcctcttattgttcgaactatcgcggatatcgcttctgacagcgctcatccataacagtatttgctcgctcaggttggcaccttccgtagaggggttgccgtgacttcacagatcctatgtatctccatcactctgaataagaaaatttacacacaatattgaattttcaaatctacgtctgatacgttacacccctttctccgctatgtcaagctttttattgactttcttttttcaaacttctatactgaaagtagttgtagtaaatataggtagaaggggtaagcaaatgaaagaattggcactgtacaatttaaaagagggcatggttcttgcaaaagacatcactacccccagcggacaggtggttcttgaaaaaggaaaagaacttacgaagcagtcgatcctgcgcctttccttttataatatcaagtcggcctgcattgtggacggggaagaaaagcaggcggctcccaagtcctattcgcagaaaatcaagacttcgcagaagtttcagtctttccaggtggatcacacgatcgtgctcagtcagatccgtgtcagctttgagggctacgtgaacgagggcaagccgttagacacatcagcgctcctgtcgaaggtcgtcgaattgttccagtcctgcaagacttctctggaattgtttaatatgttacataacatgcattcctcagacgacagcgtctatgtacattccctgaatgtctcgctgatctgccggcagatcggaaaatggatcaaggcagacgacgccactttagacatgctgacgctcgccggactgcttcacgacatcggcaagctcaagattccaacagagcttctcaacaaaccgggcaaatacaccgacgaagagttcgcgcaggtcaggctgcacacccagtacggttacgaactgttaaagccgcttccgctggatgcacacatcaagctcgccgcactctctcatcatgagcgctgtgacggcaccggttatccaaacggtcttacgacgaacgatattgatccttatgcacgcgttgttgcgatcgcggatgtttatgatgccatgacgaccgcccgctcttaccgtgctcccctgtgcgcttttcaggttatcgccaactttgagcgcgacggtctgcagaaatacgataccaaatgtgttctcgcattcctcaaccggatcgccggcacctaccagaaccaccgcatcctcttaagtgatggtcgtagtgccaacattgtcatgctcaacgacaagcagctttccagaccgatcgtgcagttggacgacggttcctgtattgatctgtcaactgcgggcgatctgcatattcaggcggttctctaaaccggcaaagccgtgtccgaaagcacccagcgcctgcgatagccggcagaagataagctgtagactgggaagttagagaaacgcaacgttccaaatgcaaccggcagcgacgattctgatcgtaaaatccggtatttctaaccatgccgcgtccggcatcctggatgagctgtgtctttccaagtttggaacattccacgcggcgtgtccgcaacctgcagacaattttaggacttacgtgcagcacggctagtgctgcttgtactataagcatgtagatacattatgtatgtatccgcatgcttatttttattataataaaaggcggataaggctagtgcggtgggacatagctcccgttttttagagtttattccgcctcttattataagcattcgtttaaacaggttggattaaatacatccgtgtaacgaacaagtctgaatggtaataagtctggcggagaaaaggaggatttgcatgaaacaaatagtaagtgtaggaatcgatgtatcaaaagggaaaagcactgtctgtgccatgatacatcctaatacgattattaaggaatcgtttgaagttttgcataccgtagaagaaatgtcaatgttagctgattacatcggatcacttgatggagaaattcgtattgtaatggaatcaacagggcattatcatcttccggttgcacaatttctgtatcaaaaaggcttttttgtatgtgttgaaaatgcatatattatacgacaattttcacgcattatgctgcatggcgcaaaaacagatccgcttgatgcaaaaaaattagcaaagtacggtttggcatactggagtgaactgaaaccatataaatttcatccaagctgctacacagaattaagtctattatccaagcagtatcagacatacataaagcttttgattgttgctaaacagaatgtaatacatttgatggatgagatgcttcctggtttcaaagaagcgctggatacagcaagcagtgttcaattctcaaaagtgaaatatgtggattttgccaaagaattctatcatgttgatatgataaaaagcatgggaaaagaaatttttcgagagaattataagcaatggtgtaaagaaaaaggataccgtttccaatcagaaaaggcagacgagctttttcacttggcggaagacggtatccctacactaccaacagagttcccttcaaccagactctgtatggaagtagcaacagagcaagtaagccaattaggttatgctctagaacaaatattatcacaaatgcaaaatcttgcaaagactttaccagaatatcaaacgatacgccaaatgggaggcatgggtgaaaagttatgtgtaaggtttatagctgacattggagacgttcgacgtttccataatggcaaagcattagttgcttatgcgggaattgatgctccgccttatcaatcaggacaatataccggcaccaaacgtagaataagcaaacgcggaaacagtgcattaaggaaaaccggttatgaggttatgaaaagtctgaaatcccatccgcccaaaacagatactcgtgtctatgattttataattaaaaaagagaatgaaggaaaaagtaagaaacaagccaaaatagccggtttaaataagtttttgcaaatctattatgcaagagtaatggaaatatataagaatatagtatagttgcataagaaaaaagcctgaataatcaggcctatttcttatgcaaaaaaatcaaaaattgtgttgacatctcttaacaggtctaggaagtccgcccattgtctgcgagttgccggacacactccggggactgtccaaacgtggaaagacacagcattcgatgccggacgcggcacggaagaactacctggattttactccaaagaatccgccgctgccggttacattggaacgttatggttccctcattttttgtctacagcttatctcctgtacactttcccggttgctgggggctttctaacacggctttgccgttttaggagtcagaaccgacacgaaccgcaaacgcccgtccatccatttcccgatcgccccgatcacctttcccatcgtaaacgctgccagaattgttccgattccaagtccatccagatgtcccaggaagaagatcgtcatgccggcggtcaccgccagacagatcacatcaaacgagacctttatgttggaatacgcggcgcccgtaatgtccgccagttccctcgggaacagatctgtcggtatgatcggcagaccacagcggttcgacagtgcaattccgatgcagatcaacagatagctgattgcaaaatagagaatacggttcggaagtgtaagcggcagaagattgatccacgccttatgcacatccaaaagttccccgaacacaaatcccaccacaaagctgaacagatactgcggcacaaaccgttttcttaaaatcatcaggctaagcaccaggacgccctggaacaggtatgtccatgtgccgagcgagatccgcgtaaacacttccgaaaacgcgaacggcacgctcgagatggcagagattcccgcgccggagtgcagcatcagcaccaccccgaagctgttaatcagcactgcaacaagcagtgccagttctcctctcacagtatgtaactctttctgttgtatttcctgtgcttccattgttatcctccaagtctgtcttccgcgctatcatgtcaaaagaacgtttttttatttcataggaaggttctgctttcttgtattaacgtgccacagtatttcctatgaaataaaaaatgtctgctgcgggatcccctcccgcagcagacctgatggttcaaaacttccattctatgatactttcagtgtaaacttctgtatttctttttcgtcggaaactttctcaatcaatgccccaagcagtgacagcttctgatcaaatgcctcgtagccgcgctcaatgtaataaatatcgtccacaacagtaatgccctctgcgccaagtccggcaatcacaagcgccgctccggctcttaaatccggcgcattgactctggcaccggtgtactggtccacaccgctgataatagcgatgttgctctccaccttgatgcttgcacccatgcgtgtcaattcatccacatacttaaaacggttctcgaaaatgctctccgtcacggtactcgttccctgggccactcccagcacaactgtcatctgcggctgcatatccgtcgggaaacccgggtaaggaagtgtcgtcacctgtgtatgacgcagcggcttcgatgccaccacgcgcacagcgtcgtcgaactcctccacttcgcatccaatctcaagcagctttgcgctgatcgcttccagatgtttcgggatcacatttttcacggtaacgtcacccttggtcgccgctgccgccagcataaaggtacctgcctcgatctgatccggaataatcgaatactctgtcgcatgcagcttctccactccgacaatccggatcacgtccgtaccggcaccgcggatattggctcccatgctgttcaggaagttggcaacgtcaaccacatgcggctccttcgccgcattctcgataatcgtcttgccctctgccatggacgccgccatcataatattgatggttgccccgacagacaccttatccagataaatgtgcgtgccggttaacttttctgcataagcccgcaccagaccatacttgatatccacatcagcccccagagccctaaaacccttcatgtgcagatcgatcggccgtccgccgatgttgcatccgcccggaagcgccacttccgcccgcttatatttgccgagcagtgcgccgatcagataataagatgcgcgtatttttcggataaattcattgtcaacattaaaatcccggataaaagatccattgatccttaccgtgtgagcatccagccgctctacccgcgctccaatctcctcgatggcattgagtaaaacgttggtatctctgacattaggtacattttctattgtaacggtctcatccgtcataactgcagcagataagatcgcaagcgccgcattcttagcgcctccgatttccacttctcctaccagcggatttccacctttgatcacatactgttccatatcacacctctatgaacgctttatacaaacacgtaattatactagtgcttacatgcttttgtcaagtaattcttaagttcttcgttcatcaaccatatagtgtacattataccataaatttcatccatttgtacagcatacaactatttccagtctgtgtcctcttcccatcagttgctgatgtatttgagcggatccactgctgaaccgttgatatagatctcaaaatgaacatgcggtcctgtagaacgtcccgtacttccacttaacgcgatcggctctccctgctcaacatgctgtccagccttcaccagaagcttactgttgtgtgcatatctcgtcagtctgccatccgcatggctgatgaccacgttattgccgtagccgccattataggacgcagagattaccgttccggcacaggatgcgtacaccgtcgtcccgatcgggcatgcccagtcaacgcccttgtgcatacgtccccatcgtctgccgaatcctgacgtatatcttcctccggaaatcggtttgatataggtcggcggaatgatggtaccgcgctcaatgactgccgcctgtgacgccaccataacgttctgatgtatcatctcgcggcttgtttccacaccgttctcatagaccacaacgtcattgcgctcccggtgtcccgtcgttccctcctgctgtacaacctcttttgtcgtataccaggaatcgttgtctatgatgatcggctcttccatgtagtcctcctcatagacctctccttttgttacccgaagctgcagatccggctccggcaccgcaatgatgagttcctgaccgtcccttatcatcgcatccgcgctgtccagcccgtttaacgccacgatcgacgacactgtcgtatcatgatccatcgcaatcacggagagacagtctccgctctccactacatatattttattcgattctttctcttttgttacttcggcaacctgttcatccacatctgcaatctgatcggcatcgacatagttctcgaacacattcacccgctccacaaattccatatcaaggatgcctgtctcatatgtggcttttggatctgcaaatgcctcctccagcgtacagatcacataggcgctgattcctgcctgcggcagagaagcctgtgcttcctccagcaccttttcatccgctgcagcccctgcgtcccttctggcaagagacgctgtcagaattccgctcacatgggagccctgatccgcaatgaccgccccgtattcatccgccgcatccacagaagccttcactttttccagaaaagactccacctcgtccatcgtcgcaaagttggcgcggtattcatcgatcgccactgtatagacgcgctgcttttcctctgcatttttctcacttagtatgttctctacggcttcttttaattcattctccgacaacaacttctggaacggttttctacactcctcactgctccatacgacttcgccgctgattctctccccggtcttttgcgtcagttcctgtctcgcctgacggacgatgtcatccatatcagtgttctccggcgcatacccgatgatgcggtcatccacgcgcacctgccgatatgtctgtccgattccaatctgcccggaaaggcaaaaaaggactccgccgaccgccaggactcctaccgcagctgcctgccagactgcctgttttgtaaacgtttgtttcttcattgaaagcgttccttcaattccataattttctcaattgtctgttccacgttcaaatgatgttcatccacaatcacatccgcatatttctcgtacaaaggcacacgttcctcatagagatcatgaagtgtctgtccgtctcttaagacaacccctcttcccttgatgtccgagagcctgcgctccaattcccggtacggaagtttcagataaaccaccgtaccgatccggccaagatgttccatcgcttccgctccgtacaccacgctcccgccggttgcaataatggcatgttccgcctcgatcccgctgttgatgcggttctccaccttaaggaatccctccggtccgacttcagcgataatctcacgcagaagctttccttccttttcctgtatcaccagatcggcatcaatgaactggtatcccatcacttttgcaagaaccacgccaacggtactctttccgacaccgggcattccaatcagtatgatattctttttcatgtgtaccttccttattcactgtggctgttccaattttttcacaatctccgaaaatcccataaaatgggacgcctttaccagaatggtatcccccggtctgcggtactccagcagcgcctcctccagcgcctctttgtccggttccgcatagaccctggtctccggcgctacacgccgcgcctcctccgcaatctcccctgcaagtgttccggtcacaaacagcgcatcgatcttcttccccgcaaagtgtgtgccgaccattccgtgcagcttcttttcctcactgccgagttctcccatatcgccgagcacggcaatctttcgtcccttcgcctgggacagcacgtctatggaagccatcatggacaccggattcgcattgtagcagtcgtcgataattgtgatgccgtttttccggatcagattactccgcccgccaatcgtgtgcgcatgctcaattccaagcttcatctcctccgcatcaagtcccagccgtcttgccacgcagactgctgcaagcgcgttgtatacattgtgctcaccagcaatcgggatcaccacctcaaactgctgctccggcgtgtgaatgaccgccttcgttccctcaaggccgatcgcctccacatcggtcgcgtacacttccttttccgcgagccgtttgctgccggtctctgtctctgccgtctttgcttcctgtccgattccatagaacaccgccggtctgccattcaccatctttttgtcacagagcttatcgtcatccccgtttaatacggcgatcccgtccggtgccagatgctcaaagctctccgtcttcgcctttaaaatgccgtctcttgtgatgaggttctccaaatgacataagccgatattggtaatgacgcagatatccggctgtgccatctctgcaagacggtgcatctcaccgaactcagagattcccatctcgagcaccgccacctgatgttcctcccggatcttaaagatcgtcagcggaagtccaatctcattgttcagattcccctcggtctttaacacgcggtatttctcggagagcaccgacgcaatcatctcttttgtgctggtctttccaacgcttcctgtgatccccacgactttgatgtcgagtgagcggcggtagaacgccgcgatcttcttcatggcttcctccgtagagtcaaccagaatatacggtcctgccggatgctcgagccgctgctcggagagcacggcaagcgctcccttttcaaaaaccgccggaatgaaatcatgtccgtcgacgcgcgctccgcggatgggaataaacagatatccctccccgaccagacggctgtcaatcaccgccccctgaatctcctttttgcggtcgcattcttccccgatgtatgtaccgccgcacgcctgcgcgatatgctccaatgtcatatttttcataatggctcccatttcagacttcattcttaattcttgtacttgcgcatggaactctcgatcagcttctcacagagctggttgaaatccacgccggtcacctttgcctcctgcggcagcagactggtcggcgtcatgcccggaagtgtgttcgcctccagacagaaaatgtgatcttccgcatccagaaggaagtctgtgcgcgagtaagtgttgagtccaagcacctctgccaccttctctgcatagccctgcatttcctttgtaatctgttcggacagctccgccgggcaggtctctaccgtacttcccgctttgtatttgttcttataatcatagaagccttccaccggcgcgatctcgatgatcggaagcgcctgaaaatcgatgacgccgacagaaaattctcttccttttacatattcctcaatgaccagctcattctcccagcggaacgcctcctttaatgcctgctcgtattctgccttgtcgtgcacgatcgatacgccgatgcttgatccgccgctgcacggctttaccacgcacgggaaatgaattccacaggtctcgatctttgccgcatcctcgccacgctttaaggacgtgcctctcggcgtcgggattccattctcgaggaacagctgctttgccattcctttgttcatggcaagcgcactgcccagatatccggttcctgtgtagcggatgccaaacaggtcaaacgccgcctggatcttaccgttctctccgttctctccatgaagcgccataaacacgatgtccgccatccggcaaagctcgatgacattcggtccgaagaaattatccgactgatcctttctctgcgcctttactttttccaggtccggcgcggtctccggaatcgccgccaccttgacgctgaccgcctcggctctgtcaaaaattccggtaagatcttcttccttatcgctatatcccataaaaacatcaagtaaaattacctgatgtccgttctctctgagtgctttcgtaaccatctctcctgtcttgaaggacacatctctctctgtgctgagcccccctgccaaaacaactatcttcatggtatccgtctctcctttttcaaaacttttctcgctttatagtatacctttttcgatctgatgacaagaatattccttgttttttcaaagctctgcccctgcgctgcgacccctttcctgctttttatctacgctcttccgctatacactcacgtctgctgtattctgccatccccaaaagccacagaaaaacctgcctcgcaatgagatccctcccgtgaatcatactgccataatgataaatcatctgctccgcttccagctttcttcccaccgcaagcgcggtcagaatctgttccaataattcaatccgttctccctccaatgggtactgatatgcaatataatccataaaccccggataattctgcatcatatccaccaatacatttgtatgtccgtagcttttcctacttgagcccttttcttttgtttcacacatgattaacttttctacctctcgcacacgcagggcacgcttaactacaattataagatactttagtactaactgtacacccctttgcacaaaaaattttacagaaagcgccctctgtcagctcaaactccttttttctccacaaaaagaagagggagtgccgcatctgcaatacggttctccctcttctttctgtaaatatatcagttcattatgagacagcacatctcaaacgctcttaattctccggctcgatcagtccgtaggtgttgccttttctcttatataccacattgacatcttccgtctctgcattgatgaatacgaagaagtcatgtcccagcagttccatctgcacacatgcatcttctggatacatcggcttcatggagaacttcttggtacggatgatcttgatctcctcatcctcgtctgcggctccatccaggaattcctgcttaaatacagcggatgcattctgctgctttgtcaccagcttggttctgtatttcttaagctgacgctcaatcacttcctccacaagatcaatggatacatacatatcgttgcttacctgctcggagcggatataatttccttttgccgggattgtaacctcggctttctgtctctccttctccacgctcagcgtcacatatacatcggtatccggtgtaaaatacttctcaagcttgttcagcttgtcctctactgctgccttcagcccctctgttaattcgatgtttcttcctgtaatcttaattctcatgatgtccaacccctttgccgtttatttgatacaagatatatcatggttatattataacatattttggctttatagcaagaaaatttatgcatttttcataattttttctgaaaattcatcaaccaagcgtcagtgcgagataaccgtcgcccgcaaccggcagatctgccatcgtcttcggcagccagatcatgccccgctcccgtccgtacgatgctgcgctggttcccgtctcttccataagctgcggaagcacctgtgagagagcgtcgtccgacagcgttgtctccagtatcacgagctctttttcccggatatcatacatcagaatatccctgtcatcttcctgctcattccgtgtgtttttatcctcacagctgactgccgccgtaccgccgccgcagcttgccgcgagttccatcgcataggaaaccgcatccacatcccagtgtacatacccttccttcgcgcacttttcatcccggatccgtacatactcctccggtgtgacaggctccatgcatgcaaccggctccgtgtcctttacctcgagcgccgtaatgtcactgccgctcacatttttgcgttctccctggaatgcattcttaaatcccagattttcatagtaacggatcagcgactcctcggccggcgacagaatgagcggcacctgatatttttcttctgcaaagcgcagaatctgttccgcaagcttctgtccccggtattccggcagtgtcgcaaccgcatacacatagcgcgcgtccacatacgctccgttgcacaggtactgcaccggcagaaaacttgccatcgctaccggtcttccatcccggaaaatcacgagcatattctctctcgtcattcggtgcttcagataaaactgaatataatcttcctcgtcgccaaagcatttctgccagatttcctgaatatacggcgcatcccgcttggggtccgcatagaccaccccgctctcctccagttcgtattttggaaggagaatatccggataataggaaagctttgcctttctgagtccgggatcgccagtgtcctcctcgcggttgacatacgcatacccttcacattcatgcaggacaaactgctggttgatcatcggatacgctccctgaagatccggatacgccttttcaaagtgcacaacgaacgtctccgagttcagccgctccccgatcgaaaacgcgacgatctgcccgtctctccggagcactccgccgacaagtcccagctcctgcatatgatcaaacgcctcatggagtaccgagatctcctggttcatctcctcattccacttttcctcgcgcatgtgaatccacgtatacgtcatcgtgcggcattcttctatgttttcagctgtcatcggctcataagaccagtctcccgaatctttaaagcgggcaatgtgattgcgctttccgtgcagtttcttgccggcaagcgtcgcaagcttctctcttgcatagatatagtcatagtcgttccggtctccctcgattaagaaccttcccgggaaccactctagcatctgcgcgcggtcctgctcgctggcaggtgctatcagcagctggattccctcctcatggcaaatcgcaagcagctcctccaccgccgcttttttgtcgccgtttccaaccggaaatgaaaagcagtgaatctctccatctataaaccgaactaccaggcagccgtgaagctccgccactctgacctgatagacatttctccacataaaattatttgcaaacgagtattcgcaggcattccgatcatcctccgcgaacttctgatccatccatgccttatcctgcagtgttatctcgtgaaatactgtttcttctggtttcataaatacctcaattctaaatttttaaaaggcaaaaaagaaccgccaacctgtgttgacggttctttttctcagcccttcatcaagaacttaataattttctctgtatcttccggctcgtaagcgacaagctcaagctccggaatctccacatccgtctttaaaatactggtaagtgacacatactggcaaagctttgacttgaggttcagtctgtccccctcaccggtaatgagttccacttttccctgacaggagtctattaccttaaaaaatccgtcgatatccgtgatgttcttgatcttcataatgcatgctcctttcttaatctgagtctctatctacactataatacgaaagtacctcttctgcaagttctaaatcgtaaacctggaaatatgttccttcagcgtctcggccgtgttttccatctccttcgagtctttctgcacatctgcactgttctcggagacaatctccgccagttcctgaatgctgaccgcagtcgcctcaatcttctccgcggatgccgactgttcttccgtgatagctgccatattggacgcggcatcgtttacttcatgcactttctctatcattccctgcacgatccgttccggcagtcagacgtttctcgcctgacgcattgcctccagaatgatgctctccgcacttttcgcctccgccttggtgagctgtggcgtatcttttaatgcataatcaatgccgagattgtcatatttcactttacccatggagtgatacggaagcacctccagcttttccacattcgagagtgtcgcaagaaaccggcccagagcctccagttcttccctctgaaatgtgatccccggaacaaccacatgccggatccagaccggtatctgtttttcatccagataccttgcaaacgcaagaatcttctcattgtcctgtccggtcagcttccggtgctcctccgcatccatatgtttgatgtcaagcatcacaagatccgtcactgagagcagcagatccaccttctttaagcgttcccgctcctcctccgacgtgccgccacacccggggaacataatgcccgacgtgtccagacaggtatgaatcccgcgttcctttgcccctgcaaagagctccgtcaaaaaatcaatctggagcatcggctctccgccggtcgcagtgattccgccggtccggtaaaacgaccggttgcgctccatgcgcgaaaggatctcctccgcgctcatctcctgcccgtcctccagatgccaggtatcgggattatggcagtacaggcagcgcatgggacatccttcaaagaacaccacaaagcggactcccggtccatccaccgttccaaagctttccatcgaatgaatttttcccataaagtcctcctttttaatcccatccatctgatattcataatgcaatcgcgcgagccggcttatcccggtgtcccagccgcaaaagcagcagggcaccggttccggttcgcgcgatttatcctgtctgtatcacttccacatgaattacatgcgctcgtggaaggttcttgcaatgacttcgtcctgctgctctttggtcagcttgataaagtttaccgcatatccggaaacacggattgtgagctgcggatactgctccgggtgtttctgtgcatccaaaagcgtctcgcggttcaatacgttgacgttcaagtgatgtccgcccttctcgacgtaagcatccagcagcgccacaaggttctgctcctcgcccttctcatccttgccgagtgcatccggcacgatggtaaacgtgttggagataccatcctgggaatccataaacggcattttcgctaccgacgcgagagatgctaccgcaccgttcgtgtcgcgtccgtgcatcgggtttgcgcccggtgcaaaggcaacacccttctttctgccatccggtgtcgcacctgtgttcttgccgtaggatacgttggatgtgatcgtgaggatcgatgtcgtcgggattccgccgcggtaggtgtggttgcccttgacatagccgatgaatgtgtgaagcacttcctttgcaatgtcgtcgacgcggtcgtcatcatttccgtatttcgggaagtcaccctccacctcgaagtctacagtgattccgttctcatcgcggatcggctttacctttgcgtacttgatggcagacagggaatccgccacaacggaaaaaccagcgattccggtcgcgaaccagcggcgcaccttcttgtcatgaagcgccatctccagcttctcgtagcagtatttgtcatgcatataatgaatgatgtttaaggcattgacataaacacctgccagccacttcatcatatccttatacttatcccacacctcgtcgtaatccaggtactcggaagtgatcgggcggtacttcggtccgacctgcttgccgctgatctcatctacaccgccgttgatcgcgtacagaaggcactttgcaaggttggcgcgggcgccgaagaactgcatctccttaccgatgcgcatggaggatacacagcatgcaattccgtaatcatccccgtgtaccacacgcatgatgtcatcattctcgtactggatcgcagagtgcctgatggatgtctgtgcgcagaaacgcttaaagttctctggaagctgtaccgaccagagcacggtcatattcggctccggcgctgctccgatgttgttgagtgtatttaagtagcggtaggacatcttcgtcaccatatgtctgccgtccacaccgattccgccgatcgactccgtcacccaggtcggatccccagcgaagatggagttgtactccggcgtacgtgcaaacttcacgcagcgcagcttcatgacaaactggtcgatgatctcctggatctccttctctgtgaacgttctttccttgagatcgcgctccgcatagatgtcgaggaatgtggaggtacgtccaaggctcattgccgcaccgttctgctccttgactgctgcaaggtaagaaaaatataccgcctgcgtcgcttccagcacgttgttcgccggcttggaaatgtcacagccgtaaatctttgcaagctctttcagcatcttgagtgcgcggatctgctcggaaagctcctcacgctcacggatgacatccgaatacatgatcgtacgggtcgttgcgagctgttcttccttgtcctcgatcaggcgatccacaccgtagagtgccggtcttctgtaatcgccgataatacgtccgcggccatatgcatccggaagtcccgtgatgatgtgtgccgaacggcatgcgcgcatctccggtgtgtaagcatcaaatacaccggcgttgtgtgtctttctgtgcgtggtaaaatattccaccacttccggatctacatggtagccgttatcctcgcaggctttcactgccatgcggattccgccgtacggctgcagggaacgcttgaacggcttatctgtctgaaagccgacaatcttctccttgctcttgtccagatagcccggtccgtgggatgtgatcgtggagataatcttggtatccatatcgaggacaccgcctgcctcacgctcctgcttcgacagttctaacacttcgttccataaatctgtcgtatcctgcgtcggtccttccagaaagctgtcgtccccgtcgtaaggcgtatagtttttctggataaaatctctgacattgatctcttcctcccagcttccccgctgaaagcctctccattcattctgcatgattcttcctcctgcttactttgtaatgtgattatgttccctgcccgcaggcagcattgccaaaacatgatattagttagttgcggctaacctttacgactatagcacagcacacttttccctgtcaatatcaagttttgttgccaggcatgtttgtcttgtcttactctcagtgggtattttatgctttttgaaccaaagcatcttttgtcttagagatgggaatcccgggtacttttccgataaaaagcccctgattcaaaacaagccgactgcccgggtacattcgcccagacggtcggcattagatacgttatactccatgtggttcttccacttgttccgtcagtcatataacatcttaatcttacagtatatgatgatttttttcaataggaaaaattatacaaaatcatagaacgccattccattcttcgtcgagttcttcacgtgatacagcgcctgatccgccgcccggtacacatccacgaacgtgcttcccgattccggcacaaatgcaacgccgacactggctgtcggttccttgctcaggtgcatccgttctttttcggcgcgtacctccgtaagaagcttttgaatcttctcttcaatctctctccggtcgccgatgtctctgaggaaaacagcaaattcatcgccgcccatcctgccgatacaggaatggtctccaaacacttcgtttaagattcccgccatccgcatcagaatcatatccccgactccgtgaccgtaaatgtcattgatctgcttaaaattatcgacatccagaagaatgaatgcatcctcctcatcgccgcctctctcctgaagcgcctcgcagacatgcttctccagcgcgccgcggtttagaagcttcgtaaaggagtcctgcatcgcctgctccctgagcacctcgttctcctgccggcacagttcctcccgctccatccggtcggtaacatccataaagctgacatagcagagcggtccctcctgcatctgcacattcaccctgcttaatatccacttgtaaccaccgttcttcgtctgcggtcttgagagcacctcaaacggcgtcccggaacgaatctgttcattgtgctcgcggatgacctcccgcagatcgacatccatcagatccgtccatccgtcctgcatctttctgatatactcttcccgcgtgtatcccataatctcacacgccgtgtcgttgacatagtaaatcttgcgccgaaatccctctttgctcacaatcagtcccatcggaatattccgcatgaccttgcgaagcactttctcctctaacgtatagctttccatataccctctttaaaacctcttccccaattcccctatcgttctcatgaagcatactacggagtacagtataatactttttacagcaaataaaaagtccctttcgtctttttatataaatgttacagattggaaagcttcttttttgttatatcacacaaatctattgccgcataccccactcttttcctacacgcacagctctttttcacgaaacagcgcgtccaccagacattcatactcagcaacccgctcacattttcggattttttttagacgctggtccgcatccgcaaagttctctccccagtacgcccacagttccttcatcttaaataaggtatttttgtccccggacatctgctgccggtatccctccaggatcgcattgtgaaaccggaaaaaccgctcttttcgctcctgcttttcctgtctgccgccggaaagttcctccagaagccaggggtgctttatcagtccccggccgatcatgaacttatccaccgacggaaagccctcccggatgtgcgccgcggacgctgcgtccacaatgtcgccattataacagagcgaatgtctgctgtttttctctgcccgtgcaaatgcctccagattgacccggttcttataaaaatcggtctgcaccctcgggtgtacgatcagttcttctaacggatatttttcatatatggcaagcagccgctcccattctgcagggttctcttttccgatccgtgtcttgatggagatccggagcggacatttttcaaaaatctcttccagaaaatgatccagctcgtccggcatcgcaaggaatccggcgccgcgccctcttgccgccactgtgcccgacgggcagccgaggttcaggttgaccgtatcgtacccatactcccgcagaatctctgcgatcgccagaaaatcttctgcgcggttcgtaagtatctgcggaacgaccgccattcccgcattgtgttccgggcagacgtcatttttctcccggtgtccaagctttttattcgccacaaacggcgtaaaatagcgttcgatcccgccgtaatattttgcgtatgcattccggtagacatatccggtgacaccttccatgggtgccatataatactttatctgttccaactgtcttctccctctgtcagaaatctgtcccttatcttaatacagctcttcccgcctgtcaaatagtggaaaattccgcctttttttgctatactgctattgatacagctttcacaaacccgtttatagctcattatattcaggagaatttctatgaagtcgacattttcagacagcccgggcaatcacaaccgatggttccgcccccatttttcgcatttttgtgcgacccgtctcgggcgtttcatcaacgaatccagatatggcggtattctctatctcgccctgtggctggttgtactcgggctcgtttttactctttttcagaccatctttttaagtatcgcctataccggccggctcacgccggatgattacgaagtccttcatgtggagcagaccgaatatgaccagagtatcggtgcctacgattccggtatcatcagacgtttttccgattacctggtaaccgtgcaatatgaggttgatggaacgcgctatactgcagatctttcactcggtcaggcatttttcaccggaaaccgcgtggcacgcgccggtgcagacggctcgtctgtacttggcaccattttctataaaagttccgatccaaaacgcctgaagtacattccggccagacggcacattctcccattttcaaccggcaaatatgtctgccgggaggataccgatgattttgccgcacaggtctgcgcgcttttacagcaggaggattatggctccctcgccgcgctttcttataacggcagagatatccctgtaaccgcggaagacacagaagaatattttcatgatgatctggtgtatttccgtaaaaatgtgggggatctttcgttgctggagggaactaccgtatatcacgacaccccctgggcaaccgcagttaccatccgctattactccaaggaggcacaggagacatactctgactatctaccgatcacagtgaaggacggacactaccggctggatctccgctggaaatactgagccgttttccctgcctcccctcgaatcaatgcagatgcagtgcatttttcagaagttccagttcttccatgtaaatgcagtgggaaattcggttctcccggacagcagatacgcaatccgcgaagtccatccaccggacctcagacacttcttcctcctgcagtacaaaagcttcctcctcgcggtcaagccagagtgcatacacattgctgacctggttatcgcggaacatgctgccgtggaattccctctcaaaccggaaccggcgttgtccacaataaatcagttcatcgccgttcatgtccacacccagttcttccttcaactcccgcaccgcggaaggaatataatcactccccgcaggaatatgaccggcacttgaaatgtcataacagcccggatctgaatccttattgtcgctccgtttctgcaaaaggatctgcactacgccgccgcgtctgcgaaaaatccacacgtgcgccgtacggtgccggattccctcacggtgtgccacctcccgcggcactgtctctcctgtcggatttcccttttcgtccacaatatccagcagttccatctctgctcccctccagtatgattgtattcttttcattcactatagcacacttttgctgcctttttccacatatccgaaattcttccgaagcgtctgatataattccactaaaatacataatctctctcttgaaaaaaagctgccgcattcagcagatcgtcctgtttgacgagataagtaatattatgagaagcataccgttacgatttcgggtggaatgcctagggaacattctgttcaaaaaatgcggcatttctaaccagccggtggctgcatctgcgatgatccgtgtctttccaagtttggagcactccgacggggcatgtccgcactccggaagacaatttgtaggacttttgtgtgtgtcccttattggcaccagacaacagctggcataaatgccacctttatgtcgaacaaaacataaccgcgcgaagccgctgtctgagtcggcatctgccctattttcaatagcaaatgccggcgagttcggttcgcgcggttttatattgtctgtgaagaggtgccattagggacaccagaaagtccgcccattgtctccggtgtgtcggacatgcacccgtcagtgtccaaacgtggaagagacacggaatcagatgcagtcatccggctggaagaaatacacacatttttctccaacgaatgtttcctatgcagttccacccggaatctgcatcatgtgcttcctgtaatattacttatcatcaactgccacctgtgatatgtggcagcctcttttcaactgcctctccaatctgttacagtacctgctctccgttcacgtacagatgatatccgtttgccgtgatattggaggtatcaccgtcaaagcttgtgatatagctgtcgccggtcaatgtccatgtcgaatcgtcatccagggtcacgtcaaccgtaccgccgtccccgtccggattgatggcaccctcgtagctggtgccgttcttcatggtaagtgccaggcttgaaatctcatccacgagaatattgcctgcaaactcctgtgaatccgccgtcagtgtcacatctccgccgtttgcgccctctgtgccccatccgcgggaggaagagttgccttccacgcgaaggaatacatcattggcaagtgtaaatgcgacgtccttgagtgtaatctcacaatccgtattggtaatatagaacatatctcccgtcttcgccgtaatgctgccgccctctgcagagaaggtcgcctctccgacatctgcatcaccggacatgctctggtaaatcataatgcagtgaatgttttcgtccgagtctccattataagtgttgctcatatttcctgtcacttcacagtcggtcagtgcaacggaattcttgccctctaccacaacgccctcgctggcattcgctgtcagagtcgcgtctgacacactgatacctgctgtacagtagattgccgggcttcccgttccgtttgtcacataggaaccgccgtccacattgaccgtaccgccgccccggtcgcttcggattgcggctgcggaatttccctgtgtctcgacatccagatttgcagcgttcatggtaccaccgccggtcgtctggataccgccggaattattttctgtcgtgcggattgtggaatccgaaatatttacaaccgtgccctcgccatagctgaacacaccattaccgtttgtcacgctggtattgaccgtcgctcccgtaatcgttgccgttgcgccgtttagcaccagaagtccggcattcagtccgtaaaaatctccatcctctgtgttcgatgaggagccggctgtcttctcgatcgtgatatcttttaaggtaacagtcgctccgtcgacacgaagtgcgttctcatcatcaccggtggatgtgtaagtctcactatccacctcggtatcctcggtaatcgtatttgcagaagttccgtttgtcacctcaccgcttccgccaaatccgccgcctgcatttaagttgcgcacagtgacagacactgcctggttgtcttcgtccagaactacctccaatacgctgccgactgcaatgtcatctgcatttccctcgccgcttccctgcagatactctaatgtgatcgccgtatcgtctgtcagggtaaaggtaatgctctcaccggaagcctcaaaactactgccgcccggcatctgaccacccagtgcgtctccgcttggtgcttcccccggcgctccgtttccgctgttgtctccgctcggtgcttctccgcccggtgcttctccacttggcgcttctcccggcgctccgtttccactgtcgtctccgcccggtgcttctccgctcggtgcttctccgcccggtgcttctcccggcgctccgtttccactgtcgtctccgcccggtgcttctccgctcggtgcttctccgcccggtgctccatttccggatgcatctgcgcttgcggttgtaagtgttcctacatccgctgtaatctgatcgccttcaactgctgtaacctgcacgatcacagaatcgctctggttctcctcactctgctctgttgcttctaccgtctggttctctgttgtattactgccgcatgctgttacggatgataccgtcataactacgacgcagcccaatgttactaattttttccatttcatgatcttcattcctctctgactctgtcaatgtctgttttcttttgatagggttagtatagaaagccaatgtgaagatcatgtgttgaccacgttaaattattctgaatctatttttcgcctgtttttcacaaaaaacgcaccagattgcgcaccacaccgaagattacaagcgcggcgacgctgacgtaaagaatgagattctgccagcgggcgaaccggaatcgtccattctgcacatatcctgccgcaccgcagatgaatactgccgtaagcggaagcagcagcacaaacagcaccggatggcaggaaaacgctcccctccagtcaagatgcaggagagccacacacattcccgtcacaccgcagcccggacacaacagtcccgtcactttccggaacagacagggaatggcgagccctgtgtacgacacgaatattccgtacagcagtcccgccattccaagtaacatcatatataatagcaattttttcaaacgtgcttttttcgtcatcctacatttccgatctgttatgccagcttattcagctcgttctgcatcaatgcatatgcaataattccaaatccaaaaatctggagaatcagatacaaaacaccgctgttgcttgacgggattccacggttattctttgtaaagtcaagcttctctccctgcttatatgcccagtaaatgccgtaaattccacaggtcacaatcgtcagcagcaccaccataccgccggatgttccattcacatcaccagaaaccgtatttacgtcattggtcagacacacgatccagtagatgccataaattccgcaggttacaagtgtcagtacaatacacaccgcaatatttcttctctcaatcataacaaactctcctttaaataagtatgaattcattatatcagttttttgtatattgtctactgttttcataccgtggccttttcattcctgctccatcaacgcaagcaccttgtgcaggatgcggtacagctccctcgcatcctccccggacagtccgatacagccgcccatcttccgcggaatgtcgaccgcctgctcctttagctgctctcccgcctccgtgatcgtcacatttaacacacgctcatctgcgtgatcacgctctctggtgaggtagcccttctgctccagcttctttaacaccggtgtcagcgtccccgaatccaggtacaaaagcgcccccatatccttcacattgatcctgccatgctcccacagcaccatcatcgcaatatactgcgtgtaggtcagatcaatctcatccagatatggcttgtagcgccgcacgatctccttggagcatgcgtacagcggaaaacagagttgattttctaattttaaagcatcatacttatctttcattccggcacctgtcgcttataaatagttttcaatcttttcgcggacaacatccatatccgccgtcggctcaaaacgctccaccacgtttccgtctctgtcaatcaaaaacttggtaaagttccatttgatgtccggtgtctccttataatccagatgcgtgcgctctaacatgctttccacgatcgtcgctaacggatgttcctcgtcaaatcccatatgtgttcactccgtatcttctgtgtgctgttactgctccatacatccttttacccatgcttccagttccggcttcggcatgaatccgacattcttgcctgccaccttgccgtcctttaagaataaaagcgccggaatgtttgtgatgccgtttgcgatcgcaagctgcgtattctcatcggtatctgcattgtaaaatgccacctcaccgtccagatcatccgccagttcctccagtaccggggcaagcatctggcacggtccgcaccatactgccgaaaagtccaccactgctgcctttgcctgtaacgcttcgtccatattgttgttctgaatcttcttaaccatgataatcctccttagatctctctttttttcttatccaggtactctgccgcggacagcgccgccacatttccctgtcctgccgccttgatatactgatacggctttccggtaatgtctccgcatgcaaagagtcccggaaggtttgtctccatctggagattaacctttacgtgattctcctccgtcgcaagtcccggcacgagctgtgacggtgcgatcgcgtctcttaagataaatacgccgtccaccggatgggaacccgcgtccgtctcaagcgcacttaccgtctgcgtgcctgtgatcgctttcggccgctcatgcacaacctctacggcatccgacagctgcggctcctcttttcccatcgggaaataatgcacctttccgacaatctccgccagatagtctgcttcctgctctgcctccctgccgtatccgatcaccgcaacttcctttccgcggaagaactgcgcatcacaggtcgcgcagtagctgacgccgcttccaagcagcttgttttctcccgggaacggttttcccatgacgattcctgctgccagaatgacggtggacgcctcaagaatctcgccggacgcctggatcccaaaataatctcccatcgcatagaccgcgttcacgcgcttctccgtcacctcgatgccaagacctgctaactgcttcttgtacccggcaaccagatctgctcctgaaacttccggcagccctggatagtttaaaatctgatgcgccttgctcatcttctcgctgagttctctgctgccgattaacagtacacttttatttctcactttcgcggtaatcgctgccgacacacctgccggtcccgttccaataatggcaatatctactcgttccataccgttctccattccccatatcgctctgcatctataataatgcaagaatctgtcgttccagttcgttcatatctcctgttggttcaaatcttaccactaccgtgccctgcctgtccacaaggaacttcgtaaaattccatttgatgtcgggattctccttataattcttatctattttgcggagcattattcccatcgccgccgctttcgccactttccctcataagtggacaacggctgcattgtcccgtccggccgctccacagaataatcataaatgcccatctcttaccctcctttctctttgtcattaaaaatgaatgtgtttaaattgtttcatttttaattgtgcgcaatctttttatgtttagattgtacacaatccatttaaggatgtcaagcattattttatcaatcatcgttctctgtgccggattgtcgtaaccggcaaaacgaaacattgcattttttcatcgaaagctctatgatagtcagcagacaatgggatttatagtagaagggtacggtgattttatgcatataagtttacttttaatggaacagattttggagctttttctcatgatattaatgggttttatcattgtgaaagccgggagacttcctacgactggagaaaaattatcttaaatattaatatgatctcaattgcacttggagcggttttattttttgcccaaattcatctgcctgaaatattaaacaacaccctctcaatcgttggaaatatgattggtccagccagtatgatcgtgaccggaatgcttttcgccggaatggatctcaaaaaaattttcggaaataaacgcgtatatattatttcatctttaagaatgattgttattccgctcatcgcgcttgccctgattaagctaagccggattgcggcactttcttccgatgcgccaaaaattatgctcattgtgtttctggcaatgattacgccttccgcatccacggtcacacaaatatgccaggtatatggaaatgacgcaaaatacgcaagcgccatcaatgttgtgaccacgctgtgcgcgattgtcacgatgccgcttatggtgttactctacacgtacattaatcatcggttttctattctgcatactttctttcccccatttgcatgctcaacataagaccgctctttcattcatttcagtatctgattccatcaatgtacttttctcttcttccctggatacagcttttataattctgccactttttgtatttatagttgtcacatgagcattcccccattcaaacaacctcatttattattatgttattataatatcacagttcacaaaaaacacctcggaaccaatatcccgaggtgtaatacacttttctgaaatgccgtaaagacatttgagttgtaaatcctatctctttgagaactaaaactaacgctttgagagcgtgaaaagcccacaaattcccagaactactcattactctattaatcttacaattgttactcttcttaaatatactacgcaataaaacatttcaataacatgcagatttatcactaagctattttctctttacaatagggaagttcatataatgtatccggatcaatatcaatacacttacaagcatctctgtttccacttatatcccatgctaatgtatcattcataactgtacatgtatcagtaaataccgaaatatccttcaatggtttaaaaatttctttatccaacatatttttcatatcataacatacgatttttccatcttcaaaatacacatatactgtgtagtctttcataggtactacctgaactaccttcggaaacatagacaaacacctcctatacaagtggattaattctatttaacggctttccatcttttgataattcccaattttgcatcaactcatcttgatgtaacacacaccacgctaaaatcaactttaactgtcttgatggcaaagctcccttgatgcatctagctgtatcaatttcaataattgccttatttccattatactctgcatgaaaatgcggcggattatgatcatcataatacattgtaactcgaattccataaaataaagaaatttccggcttttatttacctcctgataatctgatgacaataatattttatatgtaaaatcttctttatttattctaccacagttcttacaaaaaaacaccccaggacaaaaagtcctgaggtgtaatatacttttctgaaacgtcgtaagacgcactggattgttgaaatcctatctctttgagaactaaaactaacgttttgagagcgtgaaaagcccatcaataggggatttgtgtatggtagtgttgcatatctgttgtatgcgtagcactacctactcattcccagaactactcattactctattgaagaaaggacaatcattatgaaaaaatactttgcttactacaaccaatacaagaacggaatcgacattgcatttgatgacaatgtacttctgtttatctcatgttctgaatcagaaaaggatctccatactacgcctaattctcaaaggctaattgataatcttgcaattgatgaaccactcaaatatgctgcactagctcttgatggtgagttacaggcatgggctgatgctatggatgaggattggtgtttctaaatatttcataaatatattgcacctatattcttttcttgttatcataatgctggtattaccctattcgataggcgattagtccctcagtagagggactgtgaccctctgattacatagaattaactttctttctcagttacatttgaagttttactaaaataaaatactatttttttccaatccatctggataattgctaaccctgtcaagaaactattgtttatcaagttccaagtttcactatcaattttctcttgatatagccacacatttagacaaacaaatatcagcatatatatcaataagatttgatttttaagttgttcatcatcataggttttgctctcttcttcaaaccccaacattttattaataaaccattgattaattatttttcctaatattcgatagactactataaataaagaaaacatacaatacaatactaaaatgccatagttttcatctaccaacttcaaagcaaagatcgctagcaccaaaaaaatggtagcacagactgacatagtaactactgtcgaaaaaatatttttaaatctcatagttataaaatatgcaaacattgttcccacaaacaagattattccaaatctaaatgatttattaaatataaaacccgctattagaaaacctgttataaccagcactaattttccgtgtagattattctcaaaattaattagtactaatactattccaagcattataacttcaatacaggcagtcatatacgtaatattttcgtaagaaaacccttctactttatttttatataataatgaatatataattgtacccactgttacaagtaatacgcctataataattgaagtaatatgaaaccttttactttgattttttttaaatatcatcttctcctccgctcttttttataacaaaaacagttgctaatttttcatatattgcctgttccattttgcttttcaacaaacgtatattatcatatcgttcttcattatcttgaaaccattttaatatatctgtttcctttataacttgcctttcattatcatctaaaatttccagtatttcatcataccaattattaataatttttatcttctgctctttctgtaattcatcatattcaatacactttcctattcttgaatacatagcaggtcccaaaatcttttttatttcattttcactcataaagttacaggtacatataaaaatagaatttttcagatccacttcataattagtatctacatacttcccttcatcaaataattcataaaatgcattatagaaattgggattaaccttatcaaactcatctattaaaattaaatttgactccctccccatcatatcacgtgcgaaacttgcttttgaatgttccgatccaaatacataattatatgcttcaccagtctgcatcatagaaaattgaattcttaataacgctccacccaaagattcactaatacattttgccgtttctgttttgccaactccagatggtccatataacataaaaacggctggcttttgacttttttcttttgtcaatctatataaaccactaattatttcaatcttgcatttttcctgccccaatatattcttattcaaatcattatagattctcttaatacgtggaatatctaatttagcgtattctgatttacaatattcgatttcatctccaaattctgattgtagattttccagaacctttttgggaggattatgtacaaacaatttttcaacatcataattcaaacttattatattagtaaaattcaataaagtatgttctaataccgaaccaaaatcgtccgccttacatatcaaacaatttgcgcctatcttttttttcagaaatatttccttcactccagattctgttggatgaattctagcattataatgttgtattaattccataaaagaaacaacttcgtcattttctgtgtctattctttcctgtaacaaactattaaaatctcttttagagcctgtaaaaacaattacttcatcaatcattcgtctcaactcccgctaataaaacatcataaacatcaagttttctatttttatctgtatcatcatcagatgttttcttttcagaagaagtataatctggattatccttaggtctactataaaaatcaatatctaactctttatttacatctaattgtgataatgttgttgtcccaacttttattgcatatatacttaggttcatttttaacaaatcattaattttatagttattttttagagaattgatattaaatcgtagcacaactttacttttccctttagttcctacaaattcataatatccttttgctgactttaacgcattatccaacttctctattgctatatcaaattcacctgccggaacgcttgctccaccttttaacattgataagtatggcgacaccataacaatatatgataacgaatccttttctactgatatagtgtatccttcaaatttctttatacttccttgtgatattttgccttttctattttgtttttcatcattcaaaattcccaagaaatcagttaaaatagtgtttttaacaatattttttgccattttatttgtatttaaagaaattcccattgatgcatctgcagatgcttgagcttctaatcccaataaagccttaaaaacaccacttattcccgctttaccagaaaccgaagcatccgtatttatatttttatctgtttcttttaataactgtgttgtcttctctaatgcacctccagcaataatctgtacataatcggttactgaatcttcatcaaaatatactattttacaaattgaattttccattacattccttctttcatttgtcatattcactagcttccatagaataaatcaataaaatacaatttttacaattctccatattattaatattcatatatacaatcatttcacacaatgtcttgtatgttgcattgaaagtaatgattccttaatacaatcatacagttcttcatgtcctattgactgaagcacctttttgtcaaatgcttgtctatctgcattcattaattcatcttcaatttccatgacattacgattcttaatttttgaaaacaatgctattatctctgctgcatcttcctttgaaatcaactctggattaatcatacatattttttgaaaccctgttttacttatatctaaaacaccttgccctctaccaaatccatttgcttctattgcaaacataccatatatagaattaagcaaagcgaaaaccagttctttattagctacagaatctttatatttcatcgcaattagcctttgatcaactatcacactttcatttaattctgcgataaaaagtcttttatcaggattttccgaagtaactaaatctgctctattaattgatggcatttgataccatggtgaatagttaatacttttggctaatggttcatacttatcatttgagaatttgcgaatccatttcagtgttccttcttctccatcttcttttaactgttcaattgtcttattacagcaaaatgccttcatatttggagaagccgaatatttttttatatttctcgatgacttcaacattggatataaaaatttatctgctattgatgtttcaccatttatataaaagactttattttgccctgtacgctctcctctaatcatacttaattctttggtaattggttcaatatattcctgtatttctttaatccacgaaatattatggaataaagcattcaatgaaattccatactgcataatattatcaatatcactaagtgaatattctttcatagttgcaactgattcatcaataacttgatgaagaacaatactattaattaatgtttctttatcctcctcctcgattgtatttatatccttattagttaaccaaaaactaatccgctttgttttatctggaatactaatttctttttttcttaaaataagtatagttccaataacatccgcattattaaaccatctcttgcaattgcttataagaaccgattcgataatgtaataatactgcaatgcttcgaaaaaattttttcctatatctgttcctaaccaagagtttgaaataataatcccaagttttccgttcttttccaataactgtaagcgatgaataacacaccgcctacccaaaacagtaaacgactaccatttactttaggttttccctgctatctacatggcaggggaattctgttttccgggacattggattccacatcaatgatccccgaacactgctctttgataaattcactccatggcatcagctgttctatacctgcggacgagttcatataatccggcatatacagcagtaccatatagagatattggaaaatattcagattgtttgcttttgctgtttccacaatgctgtacattaccgcacttgccccagctccagcttctgatgtatggaacaggaaggctttccgcccaacggcataacttttggctttccgttccgcacggttgtttgaaatttcacaccggccatctatcatatagttcatcaaggtatcatgatgattttgggcatagttcaccgctttcccaagcttgcttccgccagttggatgcagtgtgccaagccagttccagaactgttcccatacaggctgttccagaatggttctttgttgttttcgttcttctgcctccagttcttttaatgtgcgctccaggtagaagagcttattgcaatacagcagtccaatttctgccgggagcagctgttccagcttctcttcatccggaataccggtatcctcgatcgcttcatcagagttaacatccagaagtttcaactttttacgtctggctgccgggactgcttcaaagaacttacgtcttgcatgtgcaaggcagcagaccagtatgacatcttcaagcctgttgtaaccctgatatccgtcacactgtaccattccatggaatccttccagaaattcctgcacacaggatcctttccggcttggctggtaatcataaaggacaattggtgtaagaccatcatttccggttgtatataaccacatataagaggtctgttccgccgtacgtcccttttcccgcagcacctgacatgttgtctcatctgcatgtaccaggtcccgctttaaaagttcttcatgcagccgatcatagatcagatagaaatagttttctgccgtataaatgatccagttcgccatggtttcccgtggcagggtaaatcccagctggttcatcagaaattcctgacgatagtaaggcattgccatgccgatcttttccattgcaacatatgcgaccatggatggggaagccgggctgtgtggaatcaatgctgtaggtatcttggattcagcaaatgtcccgtcaccatcttttctgcattccgggcactgccatttctcctgataatagtggattcgttccacctttgccggggtgatccgtagttcttcacggacaaacatttccgtcacatactccatcttggaattacaataaggacaatacttatcttcttccagcagggggatgacttccttatggatcggaagatttccatattggtcttcacgtgtcgctttcgctttgcgtgttgtccgtttgtggcttttgacgattgttgtcacagtttcttccgttttcttatcctgttttgtcttctcactgcctgtaccaaagagtttccgctggaattcatccagtgtttccctgagaccggcaattgtatctttcaggtcattgatggtttccttcagttctgtgatggtttcgtctttttcatctaaccgttcagaaagcatctggatcataaggtccttctgattcatctcactgttaaaaagtatgtcctgtccctttgaatccacggtgaatccctccctcttttttcgttacctttattgtacgaaaaggaaggcatggttgcaaatgccgtccaaaatcagactggcattatgccgaaagccagatagctcctttttttctcaaaatcagccagtttccgggattttccgtaaagttatgcacatcatgatgatgtcatgctcaactatccccggacaacgcaccccatgatttcacatctgtggatatcttccgtcaacagcctgctccggctgtagaaaaatttttcaaaatctacatattgcacaaatcagtaatccctgtctttcgcaggctgtatcgctttcggctggtcaatggaaagtccttccatcagccagcggaattcctgccttgtcagaggtctgacttctgaagcattgcgtggccattggaattttccattgtccaggcgcttctgcaggagtacaaatccatcccggtcaaaatagagggctttcatcgtattctttttgcgtccacagaacagaaagaccgcattggagaacggatccatctggaaattgtcacggatgactgccatgagtccgtcaaaggattttctcatatcagtccttcctgtaaccagatagattttctgtactctggacagatcaccgatcaaagtttccgcagggcagatatcgtatgatagatcacatccctgcctgcatgattattgattgcaactttacagccgtttatgataactgtcagtgcttcgccctctgatgttgcatctgttgacagcagtctgactggattcgatatcggtatatgcgattcttctgtaatggaaagtggtacgatttcatgtgtggcatccacgattagcctgtctgtctccggaatcatacatgatttctttctcagccttgtgacagtattataaaacgtattgatagagatatcattctgctcacaccagacacggtcagaaaatccactgctgcgacattgctgaattaatgacagccattcttcgtctgttcttctcttattacgcataagctgctcctcctgttagctaaagtagttaaacaccgtaaacggctacctttgcttaagaaaagaagagtgatacgtccgcatccagatctgaaaatagataaagtagtcgtttactgtttattgactgtattatcccaaatcttcaattaaatttggaacggtatgttattcatcgcttaccaataactcatataatttaaatggtatataattatataaatccgtttttcttgtaaatttaataccagtactatttgttatcttttctctccattgagcaatatattcctgctcatcgtcagcgactttattgtattctacaaaaggcaaatttgatacaatagttccaaattggggaatgatttcttctatatcactaccatctattggattttttattttaatcttatctcctgtctctacctcaaatatatccgttgtaaacatattaatcggtatatttaatgcatgaatatctgtaaccgcaatattagcaatctgtaatggatatgcatacttatctgacatccaagttgtcataaacgctttatctgccctatgtattctttgggctttattattaataattgcttttgcaatcgtacctgtaccagcacacaaatcagcacaatccttgttccaatcttgcacagtaatctgacacaaaatatctgccaaacgatatggtgtcgcatattgtccacgaatctctctctttgcagtatttacggtcttttcgagtatatcttgcaatactccttgctctattttttcaatgttattctcaattaaaaattgattataatcaacaatatcaatccatgtatcttctggtattacctcattaaattccaacggcttaaatacattataaaaatctccttgttcgactatatgttcaataatattatttccatcattaggagatgttgtataatcaatatcttttatggcatatgcacaattatgatactttttaattgcattagcaaacataactcgatttgtccaatttaacaacactgacttagcatatgccgaatacatattattctcatctttatcgtattcttcatgaaatgcattccaccaaacctttagtctgcgttccatctgcatattcttgctagactcaatcataatattttcagctactaactctttattccgctgaatcaattctgtcattaatccatccgatattgtatttacaatagacgatgttacaattcttccattaacaagatactcatttactgtcattacaatttcttttataataggtaaccactctgctttgtatgtagtaacatcttctcttgatttaatatgacttgttccatcccatactttggcttcctcgaaaaagccttgtttgttctgtatatataattttccataggtaaaattccatattacaaaactgttcaagcctaatgcttttgcctttcttgtcgcatctgcaatcaatgcttcatctgtaatcaatacatccggcattttaagttcccagccttgcagtattttagtttgtgcctcatcttcgtacaacaaaacgtctggaaacatacttttcttatttacagaaagcgtactttctccacctgcactcttaatctttaaccccaagccattcagcattacttttatctctgaaataattacgattgcccaacttctttcatttcttctgataattgtccccatacatttcaccttcatctttctttaaattctgctataagattttcctcttttatatatttacgagtttttttttctaatccttcccatgctaagaataatcttctttttgctacatcaatataatctatttcttcttttttaaacaatgcaacatcttcattcttttcaattccaataaaatttcgcccttccatcaatgctgccactaaaaatgatccgctaccaaaagtattatcaagtactatatcccctggatttgtatatgtccttaccatatatctgcccagttctataggcttctgtgttggatgaagaactgcaccttctgattctgctgttttaatataaataacatctgtaggataacggtctccatcacttgctacatgcactggttcaaagtctccataattaccactaagctgattttttcttattcctttatcatatggttctccctttgtcatttgaggatgatatgttggctgttttttataaaaaacgcaaacatcttcatgttttcttaatggttgctttttagcattcaaaaaattagttggctttgatttttcccatacccacttatacttataaatattaggttggctcaaaatcaactttgcagtaaaaactccattagatgttaaaacaattgccccattgggttttattattcgattatattgtttccataactcatctaaaggaatataactatcccatttattttgtgtcataccatatggtaaatcacacaaaatcatatccacacttccagctggtatttttttcatatactctaagcaatcgccttcaaacaatttgttgatcacattactcatatctatattatttttttcactattcatgccttatctcctcgaacatattttctgttcatagtatatcattttattttgtcgaacacaagttcctatatctgttttttcatataaaaatccaagataaattttaacatatatcttccgttttttccacttataaagaaaacacctttattgcactttagaagtatcacaaaggctattaaaactttttcagtcacaatagcctttgataatttttatctcccctcatacacctcccacaatctcttctgctccgctcctatcctcaatatctcctgcaaatctcttgccattgcctcaacataacatccatctgttcaactgtaccagtacgattacctgccgtaatctcccattgaacaccctcttttgagtaatattccttagtgcccacattcatatatccatacaatgaatatgaatagccatcgcttttctctatgaataccggtgccacttctcctctagaagttttccatatcatcagtcttggaaaccagcataagccttctttaatcagttccttgaatgccccaagcagcttgcccagctcattcaatattccacggaatgaatttcctgcctctattgtcttatccgcttctacctgattagcatattcttctatcgtaggtgcaaataatctgaatgacgatacaaaattcttgattctatcaagcaatttcgctgcatcttctgctttttcaatagcatttgccagctcttcatttaccgattgaagttcagatcttttttcatcgagttccattgatatctgttttgattctctactatccatttctgatagcgacttactaatccgccgcatactttccaggcatgaaatatcagactccagtttctcttttttatccgtatattctttttcaatagctttatttgccttaactgccctatccgattcttccacctgctcttgtaattgtgtcaaatgctttgtctcctgagctaccttatactctgcaacagataaatcatgatttcgacctttcgacttttcttttatctgtttcccaaaccagtcattcacttctttattcgccacctctcgaagctcatcctgcagcactcgtgataacacatctttagtaaataccttacgttttgacacctgcttgctaagacctttcttatatccatctgccacaggaactccgacaatgtgcatatgcggactgtcctcatcaagatgaaccacagcatttgcaactacaaactgtggaagcctctttctaagctcgtccagtattatctgatatgacaatttcatatatgactttatatcatcaaattgcttccagaactccctgtcgcctatttgaattattatttcaactgccatatcctgttccttacctgccacatgttcaaaataatcttcgattttccggtcttgtcgtgtctgctttttattatattcttctaatgcctcatcgaattctttatgatatactgttttcacatcatcaatcagatttgatgtaccatatatgatgcagatgttgtctttgctataatctgatgatttgtattttctcaggttatgctttgcaacagctgcaagcttagatttcgatgtaatggcacttttcttattgctcacatgagctgtatatgaaatatttcccattcgcatctccttatctgtactacctttttatctgttaaatctatcggagcagtgcagttatcatcttggctctgccacagatgataaccccctagcagttttggcaagccaaaattgcagtgggttctccgagggttttatatattatctttactattaccaagaatttaataatctgtactttttatagttgcagactctaaactcttcctagaatttagaatctgcttttccaaacattcagattgttaaactctttattccggcattacccaagtccagtaaattgttccatcttctgccttttctttatctgatgttatacccagctttttctttgccgataaaagagtatttctcttaatgctcctctttgcagcttccatcattatttcattagatggaattaccttgtttgaaccaaagtattctttgataaaattctccgcaatgtcgagcttcttttttcctcttccttcattgccggataacagctcatctatggtaatgtcatatggtcctatgcataccattccattatcctcagtcatttcaaatcctatcgcatcccctgccggagctaatgaagatttatcatgtgccattattcttatattaggtttatcacggagccttgccaccagcagaacacttctggcagttgcctgtatatcaatagaaccaagtcctctgtatgttgatttgctgccagatgccttattcatatgaccaataagaataattgcacaattatgcttttctgctattattccaagatgctttagcaccggtcttatttcatttgctctgtgcatatcaactgtagctccgatatatgcctgaatcggatcaagaatgattaaccttgccccagtctcgattattgcctgctccagcctatcatctgtcattgataattccttatctgtctcatcaataacccgaatcatggaacaatctgctcctgccttttctaatctaggcttaatcgtatcttcaattccatcttctgcggtctgataaatgatatgaataggttcatattctttatcatcatcacaggggagcggcaagcccctgctaagagctgccgctaacttgagaaccaaagttgtctttccttctcccggatctccttcaataattgttatctttccgtatggtatatatggataccatagccattccacctcctttgaaaccacatcctccatatgaataagtttcagttcaacattctgttttttaaccatattcatcctccttgctatactgcttctttgttaaaatatcctgtttcttcccaaacttttttatccggacaataatagctgaactcatttgagctccctacctttattgccgttccaaatttgagtaatccttgttgtattcccagccttacatactgtgcgtccttccctattgcacttgcaatctcttttattggtacatttctccctgtaaaagctggtaaatcaccctgatagataacttctggcatctctaccacctcctatttttatatagagcatttcttgctctgttatgttttgtattatgcagacctttatttgctctgtcaatggtttaaaatttaatgttgactattaaatattagtgtgttacatttacaatcacaggaggttgaggcaatgaataccggtaaaaagattaaattaatacgaacctttcgtggtttaacccagaaagaactaggcgaagcttgtggaatacatgaagttgcaatccgtaagtatgagcttggaaagaatcttcctaagcctgaacagcttagaaaaattgcagatgcacttggtgtcaatgttaattcattgatggaatttgatatcgaggctgatggtgatgtactaccattactatttgctattgatgaaacatttgacatttctatcaaggatttagacggagagcccggtatattcttttccaataagaatcttgttcagtttcttaaagactggcaggctatgaaagaattacttgataatggcagccagacacaggataattacgaaatatggaagactatccgcccaagtgtgacaaaggtaacccacgaataacaatcattttatccgtttgctatcagctttctagtaaatagcgaaaggatggtgcttatgaagttacccaacggatacggaagcgttgtaaaactttccggcaaaagaagaaaaccttatcaagtgagaaaaactgtaggctggcactacgatgaggcgaaagacaaacaggttcaggatatgattacaattggatatgcagctaccagagctgatggcttgcaaatgcttgctgattacaataataatccatttgataccaaggctgctaagatgacattttcagatgtctatgaagaatggtcaaagcgtaagtttcctgctatatctgaatctaatgtaaaaggatacacagcatcctataaatcctgtgaacccctttacaacaaaattttcaaggatattaaattagttgatttacagactgttattgatacctgcggtaagaattttcctactctcaagaaaatcaaagtcctgtttaaccagctatttgattatgctttgaaaaatgatatttgcaacaaagattcttcaagcttcgttgatattgttcaatacaaggatcgtaaccctaacaaatacgatagaaacaagtttgagaaaaatgaaattgagattatctgggaacaaaaggaagacaaatattatcagatagtattgatgctcctatatagcggagtccgtatctctgaaatgcttgatttgaagaaagagaatgttcatctgaatgaacagtattttgatgttatctgtagtaaaacagaaaatggtatcagaaaagttccaatagcagacaaagttctgccatattacaaagcttggtatgaatcctgccctgaatgtgaatatttacttcatacagaagttggaaaacattttgaataccgaaactactacgatagctatttcaagccattgatggaacagctaggtattaatcgtacacctcactgctgcagacatacatgcatctcaatgttagcagaagctggtattaaccagacgattatcaaaaagattgcggggcactcaggtgcaatgacactcacagagaaagtgtatacccactttgatataaaggagcttgtagatgcgattaataagatttaaacaaagaaaaggacactccccagtatctctactgaaaaatgtcctatacatatcaatatctttgttgcatacctgctgcatatgtgttgcattcgatgtaaattccagcacatctgacggcattcctcaacttctgtaacccttgaaaaatgggcttttcttgatatcttcgttcttgaaagattatctctttgagaactgcggagcgcgacgagctgctttgagaccgtattgcgcgagtttttgagctgtttttccttgatactccgggcttttccggctttctgcctctcagttatccggtgtgcggaccataaaaaacggccttttttcattcagcaatagcctgatgaaacgcaccatttactaccccaaacagctcctctggtttattgtacttcacttttgcatagatgtccatagttgttttgctgttttcgtgtccggcaaggtattggacggtctttggatcaacaccagcatagagaagattggtaatgtaagtgtgccgtagctgatgcggggttacatcaaagtccagcgtatatctgattttgggttgatttttctgggtcatgcccagcgttggggtaaccgcgtatttgatgctctgcccattcacatacttataatagttccggggcttagtggatcggacaacgacatactgccacactctttgaaactgcgaagcagccagcggctcccctttactgtcagcaatcacataatctgatatggaattttctttcgtttctctcagacaatccaccaaacacttcggtatcggaatatccctttttgccgccggagtctttagcaccgtagaaatcacgggtctgttatgctctgtacgccatgcccgcctcaccgatagataaggtgtatcctcgtccagaaatacacaatcccattgcagtgcaagaatttcttcccgacgcagaccggaatataaaccgagcataataaacaaatatggaggaagccccttgactgtatccagaagcacggctacctgctgatctgtcaatgcctctctcttttttgatggttttccgcccttgcccgatattcccacacagggattgtgttcaagaatttggtttctctctgccgcataaaaaatgcacttgagtagcatattgaccttattgtataagccttccgatttctttgacaatggaacaagcgccagccgaatatcgtcagcggtcacttcttccatatacatctctcccagaggttttatgatatagtttgtcatatccctcgtataacctctgagtgtagacgcagacacctttgccgactgcatcagcagccacttctctccatactcggctactgtcgggtgctgccggtgaaagataatttcttccacctgcttccgggcctctaactgcttctcatacaattcttcacaagttgcggcatacaaactcaactctttgccatctgcatccgtaatcctggttctgtaatactggattcctttcaatgtaatggtcccgtacttcgggatctgtgttttcttttttgccatctttgatcgtcctttcttgataatgtgtagtctccgtatctacactctctttttatcagaaagcctcgatttaatcaaagatacggctgaggtaaaacaaagagcgagacatccttgcctcgctcctgcttcatttcctatttgttattactgtgctgcatcccagcttgcaaacgcacagttcattgatctgaccaactcatttggtctgttgtacttaacctttgcataaatgtccatggtaatcttgctgctttcatggcctgccaggtattgaaccgttttgggatctaccgatgcatgaatgagattggtaatgtaagtatgccgcagctgatggggtgttacttcaaagtccagactgtaaaccacttttccgttatgagcagccttttctcccaagacaggtgtgacagtatgctttactctttttccatcttcataccgataatagctccgctccttgaccgtcctcgtaacaatatactgccaaagtcgcttaaactgcgtgtaggacagcggttcgccatcccggtttgaaaccacgtactccgaagtcgaagtttcctttgctgctttcaaacactcagccaagcaaacaggaagggggatatttctctccgcagccttggttttcaattcatccgaaatcaccggcctgttgtgttctgtatgccatgcccgccttaccgtcagatatggagtatccgtatccagatatactgaatcccattgcagagcaagaatttcttcccggcgcagacccgcatacaaaccgatcatgacaaagacataaggcggcaaatctcggatagcatccaaaagtcgctccacctgttcatctgtcaaagcctgacgctcctcttgaggaacaccgccaccttttgttgtcagataaatcgttgggttatggtcaatgatcctgctttccatcgctgcgcgaaagatagacttgtaaaggatcaccacagatttataaaccgatgcagatttcttggaaaccggaacaagggcaagttgaatatcatccagactaacctctcccatccgtttatctcccaattccgctataatatgccgcctgacctttgaggtgtaatccgtcaaggtagtggctcgtacatgaaccgactgcatcagcagccacttttcacaatactctgcaactgtgggcgttttccgatgaaaagtagcattctcaatctgttccaacgcaagcgtttctttgttatatagttcttcaggtgtttttgcgtagatagctacgagcttaccattcgcgtctttgattctggtcctataatataggacacctcttttcatgactgtgccatattgaggaagtattatttttctatttgccaattcctccacctcctaagaataatctccagcgctgtacctttgttttatcagacctctctgattccatcaaggatacggaccggctcacgatcttccgcttcgaggtttacggtaagttgcgcttctctcaactggttttgctctgtgcgtgcattttgcgatatactcctggagacctgccgcagtaaaatacacacagccattctgaacatactgcacataagagatcaagccgttgttacgggcggcatccagcgttgctatgctgattcctaagatttcagcagcttcttttcgtgtaatgagcttttccatagactatattccctccaatctgtcaaggttatcatcgtgctttcaaaatcacatgaatacgctggcagccgaaactgccagcgcatggtatctgattttgaatagaaagcggccacccaaaagagcagtcgcttcctatttcaatatgactcaattctcgtcacatttgccacgcaaccctgacgatgggaacataacaggtctccgctggcgcggttgtcataactccgcggcgtcgttttactcgtgcgccgcagggttccccccaagtctttggcgggccgtgaggaagtatctttaagcccccatgcagtcatcgcgccgaatctgccacaatccgttttatgaaatcgtagatcgctccgaagcagtcttttcatcacctccctgactgctccatcttcgcggcgcttcatattcgctcgtacatgggttatgtacctgttgtgctgtctattcgattgtcaatgtacgaatgaaggaggaaaacttgtccttcttattaacactgacaaaaaaggcaaaaaacaggcgcatcaaatgaaattttatcaaaaatattttccaagccgctttaatccacggcggatactgtcgcgaacacggcttgggtctacaccttctacttcggcaatttcatttaccgtcattcccaggtagtatcgggcataaatccgctttgcctgtttctctggcagtttcatcacagcggcatagacctgctcctggaactgtttttcctccagaaccatctccggtgtttgcggcttcaacagcaccgcattttcaatgccattctcgcaatccagagaatactgtgatttataacgatacatctttcgctcatacgcagcctccgcacgttcagctgcccgaatagtctctattacttcctctgtcacatctacaaaaaagtctgttgtataaacatcaggataaagttcccgaaggttaattttcttcattatgtacctccatttcgattcacgggtgattaacgggtgaatcgaatggaggcggggaacggcaccggcaaacaaccggatcgtctccgaaaaaatggcaacagaaaacgccagatttccgcgatggaaaactggcgcgccaaaaacaaccactattataccgaattacatagaacgataatgccgatacaatattatacttgcccggaggaggagcaatgctttttttaactgatgtagatcatgtgagctttgaaaaagcaaacgggacacggtaaattaacctccaatcggctaccgtgtccctgcaagtcgtcattggtttgtgcaatcgcaaagaaacggcggctctgaaaatcaaagccgccgtttcaaatgggcgtgtcaaattgtctgctctacgacggctttttttcttttgccgtcgtccggcaggttgtttcttttgcgcttatcttaacaagcaattctcacagaaatgtcactgacattctctgtttcgacagaataatgggttgaaatctcacaagcctgtgagatttgaaaatttattgccttttcttcatcgaatttcttttttccgaaacagggcaattcccaaaacagaagttagaaatgtcaccaacagagaatatcccatccatctgtaaggggcatttgctatgctttcatctgtcattccctctgtgtcaaacgcatctgcaagttggatggcctgtccagagggtagcagatcgctaagaacttcaagaacaatccgtggtgtaccttcaatgtattgagggttcggaagctgttcaacttgtgtagggatacccatttcattgacagtcacatagttatcgtaaagttttggttctccaagtttctgatggataaaagaaccggataccagtagaaccaaagccagtatcatactcacaactacattgcctgccttatttgtattcaggatagcaagcagcgtcataatgctggcgaaggttacagaaatcataagactgcttatcatgcacaaaaaaattgtagctgtttctgttatcagttcaccgccattcatgtttcctattacaaaaactccaacggtataggacagcgaaatcaatacactggcaatcgcacacacaataagatttgctaagtaaatccgtattcgagagtggccgactattatcttattgcgaatggtaccatcgctgtactcggaaccaataaacaggctcgtaaagattgcagatataagccccatcagtggtaaacactcaaaaaggcatccatcaagcacaaatcctatacgagcctccgaagctatatttaatgcactatacactccgtatgcaaacatacaaagcacaaaaaaccaaaatataacttttttcagcatacgaataaatgttgataccaatagtctactcatggctaacacctccgattaaatcaacatagtagctttccagattttcttcctgttcctgaatggacagcagatcacaatggtacttatccagggcagatgtaagctgggaaatatttaacctgtgataaatctctgccacattgggagcaggcattttgtaaggttggcctgtctgcttcaaaacggcggccaacgctttgccatctgttacttcaattcgaatagacttgcggaacgagttttccaaatcatccgcactgatttctttaatcatttttccgttgtcgataaagccgtaatgcgtagcaagacgggacagctcatcgagaatgtggctggataccaaaatggtaataccatactgctgattgaggttcaaaagaagctgccgcatttcaatgatgccctgcgggtcgagtccgttgatcggctcgtctaacaccaaaaaccttggatttcccacaagagcaatcgcaattcctaatcgctgcctcatacctaagctaaaattctttgcctttttcctgccggtatcctccaagcccaccaacttcagaagttgaggaatggtatcgaatgatcgtagtcccaacacacgatactgttcctttaagtttccggtggccgacatatccagatagatagccggtgtttcaatcacggcccccatttcttttcttgcgttcaggatttcgtgttttcggctgctaattccatatagggaataatccccgaaagtagcttcttgcagtccgcaaattatccgaagcaaggttgttttgccagcaccattttttcctactaatccatagatactcccctgcggaatgtgtatggaaaaattgtctaatgctttatggtggccgtaaatcttcgtcaaattctcggctttgagaatataatccaaaatattacccccttttgatgatactcgctgtgtgcgagttcctttgtcttatagccatcataaaatagaaacctcacagaaatgtcaccgccagcccccttttgtcggctaaaaattcacatttttgtgacatttgaaaacggccatcctttcggatgaccgtttcgtgtctgcgtattttattcagcaatgcgtagccgatctaccaccgttttttgtgccattttgttatagcaaaccaaaggaacaatggctgtaatgaggatcagagggataatacagagaaataccggaagcagagtaaaatgccatgtaaaataggttaattctgcacccatcatccgcaccaccgttagacttgctataacggaaagtatcagagaaccgaaaaggcccaagatagaataaccaatcccttcatatatcaacatttgcttaacctgtcgtcctgtcatacctaccgattgcagcattgcaatttctctgtaccgagacaagatagacgttgtcatggagttaataaagttcaatatgccgatcagagccaatatcgcacaaagagcaccgcccacaagacggtacatattgatcatcccgtcaaaggtctgccgcagggtcacttttgaaagataatccaaagcagtgtccgtattcgtagtgtaatttttcagccagttttctgtggcaagctggtgttcttcatccacattgaagattgttttcatggccggctggtcggcggataccatattttccaaaagttcattggttgggaaaatatagtctaatcccatgtctacctgcaaaggagtttgtaatgcgcttggaatacttaccacagccagcacatcatacactttatttgtaccatcaagctgtgtcacgctaatttgatcgcccggtttatacaagtaaagagaaccatcacccatcattcgcaacggagttacatacacgccggttccggctttccactgttccgtgtttagttcaccgtctaacacctgtacatattctgccggaaaatcatccaagccatatacattcacaccatgttcctgtcgaaccctataattttccagttcatttgcaatatcaccggaagaagcagagagttcctgtaatcgggcgaggtcgttttcagaaagcggctgtttggaagtccataagtagatatttcctatatcttcaagaccattcaaactttctgcctggctaataaaatcttggcttacactcgctgtgttatatggcgcataattgttaattactgttgtatcggaaactgtaaaatctgtaaggctgaaatcagccacaaacttatcaaagtcaaaggaggtcacataggtataaacgctattcaagagaacaatactaagggcaaaagacaaagtaacaatcattacttttttcttgtttcgagtcagattgttctttgccatcatcattgtgctgatatgcttactgcgccgctgctttttctttccaccagtctgttcaatatagtgcagtgcctccatcggagaaactttagccgccaatatcgcaggtttttgacagctaatgaaaactgtaattgcagaaaagacaatcgctaccaaaaagatcaatggatttatcgtagtaacgatccttatatcatcagttagcatatttacaatcgcaggcagcaacaaccgaccaatcggccatcccaacaatagtccaataggaatacccataagagatagcttaattgcttttctataaacgattttccttatttgtcttgcggtggttcccagtgttttcaacattccataaaaccgaatatcctgtgcgatagaaatataaaacacattgtagattagaagataacctgcaataaagataaccgcaataccggccacaagaggcagcatggaagaaagattgaccgttgccattccgtaagcgtcgttaatacttacccgttcatctaaaccatattcagaagtcacatctaatgcctgcttttcaatattccatgccgtaggcatcatcataacagtatcaatataaccggttcccacaggtggggttgttccgtccgtttccccgtggatgaccggagctacctgttccgtatatgctttggataatagcattgtttgacggtacgccacagcatccccatcccaaatgccgcaaagcgtaaaggtatcggtaaatgtatccgtatcggttgtaaaggtcaactccatttgtgtgccgactttatccggcagtcccatcgcatccagaacaatacgactggtggcaatctcatttttttgttccggcagatgtccggtatcaggagtattaaaggtcagttccgaataagtttcatcaccatatcgcagttccgtcggcgtcttattgaaatcatcgcccacggcatttcctatgataattgaatatccgatgtcttttattcctgtatccgatgatagcttctcatattcttcccaggataaacgcttgataccagcatgggcagaagtgccggttgtcctcatattactttcctgcatggcagtctgcaagctaatggcaatcgtaaacaaactggtaaaaagcaacgtagcaagcatgattgccaataccgcaatcgtatttttttgagctttcaacgagcgctttgccagaagtttcaagacaggtctgttgttattcccaaataaaatatctgtcatgttttcgccccctttactcggaaatccggccgtcctcaatacgaataatgcggtcggcaagctgggcgatctcattgttatgagtaatcatcacaatggtctgatgaaatttctggctggtcattttcaaaagacccaatacatcgctgctggttctgctgtcaagatttccagtaggttcgtcggccaggatgatagccggtttagaaacaagggcgcgggcaatcgctacacgctgctgctgaccaccggacagattgttaggcatactgttcagcttttcatcgagagccagcattttcacgacttcattcatgaaatgcttatcaacggtatcaccatccagctccaccggcaaaacaatattttcatagacgttcagcacaggaacaagattgtaattctgaaagataaaaccgatgttgcgtctgcggaagatggtaagctgttcatccttgaatttcgacaattcttttccttttactttgatactgccggaagttggagtatccaatcctcccatcatattcagaagtgtggattttccactgccagaagtaccaacaatagccacaaactccccatcctcaatggagagggttacgccatccagtgctttcgtaatattgggctttgaaccataatatttttttagttcagtcgtttgcaaaatgctcataaagaacaccatcctttctttcgttaagcccattgtaacgaccaaacctcacaggaatgtcacgagctataaattatttttggacaattcggttctaaatgtcataagcctgtgacatttattcttcggcgtacttactctgttctcgaagcaggaaaacagaaaaggttgaccccttcccaacctcggatgttacccgaatataaccgccttgcaaggttacgatctcacgagccagatacagaccaataccaattccatctacatcatgtacgatgtcctcccgatagaaccgcttgaaaattgccccctgatgctgttctgagatgccaatgcctgtatcagtaatgtcaattttcacatacatttcccaactttcaaccgaaacccggatttgaccgccctccggcgtatatttcaccgcattatccaaaatgttgaacagcgcttcacctgtccattttctgtcatgagaaacgatcaagctctccgggcagtccacttgaacattgatctgttttttctcggcgttcagaaggatacctcccaatgcggcggcaagcgtgtcataaagcggctggcttttcttttccagagaaatgacacctgtttccagacgcgaggttttaatcatagcctgcatgagaaaatccagtttatcaagttgggtggcctgtgctgtaagaaactctttttgcttttgcacagggatttcattttcaagcagggtgctgttaatcactttcaagttcgcaatcggggtcttgacctgatgagaaatatcggaaataagttcttgcaagtcagcccgctcttgtgcaatgctgttcttgttttcctgcatgatttcatacaaacggttcaaccgatattcaattttatagaaaagactttcttcttccacagtctgtttcggctgcatattcccggacaacatatcatccatcaaactgcaaaaagcatcggagaacatcgccaatttgcggcgaaccagcaccataaaacaaatagagcaaaacagcacaaagatgccgaacaatagtacataccaaacagcggttataccttgggtcaacgcatataaagccactgaaaccgtcaccattgccgccagcaggagaacagctaaaaagatacaggctttgttgacggaaagttttcgcacattcatttcagcgcccctccgatccacatatagcccataccatataccgttttgatgtactgacggtcgggtgtttcgattttgtttcgtacccggctgatagccgcagtcagagcgtgttcatccacaaaatttccgtctgcgtcccacagtttttccaacaagacttgccgcgtcaaaacgatctgtggatttttcatcaggattttcaaaagtcgatattccagtggggtgaatgtaagtggctttcctgacagggcagcactcatctctgaaaaattgatggtcagtgtgccatcctcataagtatcaccaccatattgttttgtcagccgccccagcaccaccgccagtttcttttgaaagacgctcatagggaaaggttttgtcacataatcctctgcgcccagttcataccctttgagcatatcgctttccatatcatttgcggtcagaaagataatagcggtatcggggcggcgctcttttacctcccggcagaagtcaaaaccgttcccgtccggcaaatttacatccagcacaatcaggtcatagtcctgcttcgtcaagaaactaccggccgctgattttgtcagtgcagaatcaaccgcatagcccgcagtattcaagttatagcataaagcattattcaaaagtcgatcatcctcgactactaaaattcgcatggtatcacactccttcattttcagtgtatcacccaaatgtcacagaaacctcactgagatttgttttcttttctccgcctgtctactggcttctctgcatttttaggaataagccaaatcgtcgccatttttacagcaccggggatgcgcccagatgtacacaaataatttatctggcgcggcgtaacattccatttttggcttgcctcttttaatgttatatagtccattttgcacctcctaaaatattatatttcgtcttctcgaagaatacaagtttatccctacctattactctacaaaaatcagcataatcttaccgttcatcaggcataattaggttattcctttgcacaaaccagaacgatacaatgttattgaggtgaacgattatgccgattgatgatttaactgctttagggcagaaaatgcgggaagcccgaaagaataaagagctaacacaacaggagctatctgatttgagccatgtttctgtaaagcaaatcgccaatatcgaaaaggggaaaatgaatccttcttatttgattttgagagcattggccaaggtcctgcatatctctttagatacacttataaatccagatgtttctctggaggatgaaggtgtcaatcagatgaaaatgctttattccagctgtccgccagaaatgcgtgacaccctgctgcatcacacccaggaaacggtgaaagaactgacagagttgtcaaaaaaatttgaaacgaattgagccagtgagtgaaatttaacgattctctcactggttcttttcattttcggagaaaagaggcaagcaatgcctgtgttaatacacacaggcccgcagagaagaaaatccctccgtgattttcctctccgcttgcttgttgagggcagcgcccccaagcccctttgaacacagaatttcattctgtggctgcgcgttctgcgaacgcttttgaccaggaccagcttaccgctggccgtggtctttttctttttcaacatcctgttctacctccattttcagcactcgatctacattcgcttttgcagtcaaaagctccctcatttcttcacgggagcgccgatactcggaataagtctttttcttttcttccagcaattttgcgtactctgtctgtaactctttgacctttggcagcttcttgacgcccatctcatcaaaggcattcttagcagcctggtggagcagaatttcttcctcatgttcctcccggaatttcttagagtagcccgccttgcggtatgccacatagacctcacgggtcttggcataatttacgatgtgagtacgcagaacagcaatctctgccatgcgcttttcagccgctttgatgtgcgccgaaagttcattgtgatgtgccgtggcagccgcagccttttcttccaaaaccgcatactccagcaggttattctctgacaggtaattcatggtctgcgccatttgcttcagattgaaaactttagcccatcgcgcatagccagcaccttttccagcctgcaattttgcctgaatgtccaccagcagattgacctttggcggctctgcctgtgtgactgttttctttcgcggggtatgtgctttcttcccggagagaactgcccgcaaatcttccaatccatatccttcgcccagactgtccatacgggcggctttctcccaaccagagagcttcagtcgatacgattttccgcgctttgaaacttcacaaccatactcttgcaacagcttcagcagttcttcaaagtcagcaggactttgtgataatgcgttgtcaatcgccacacgaagcagctctcggtgagagggctttgcctgatcgcccagccatttgttatagctctttccgtgaggtttcggattctctacaatggacagtccattctcaatacagatggtgtcacttagccgacgaaccgccttggtgctgccccaaaagtttcggaacttccggtcatattctaagctgaccgatgaccagataatgtgattatgaatgtgcgacttgtctatgtgagtgcagaccacaaaggcatgattgcctttagtaaaacgctttgcaaattctacgcccagccggtttgcttcttcctgggtaatctcaccagggcggaaggactggcgcacatgataggcaatcacatcatctgtaccacgcactcgtccggtagcggcaatgtactgccgctttgccagaaggaactccgcatccgcagtccggctgtcacacgcatagccggtaatgagcctgccgttatctgttttctttggattggccacatagtcgatgatgtcactgattgcccgactctctgtgcggcctttgccgacatgaagcggcatgattcttgtagttgccataataggaggtcctcctctcataaatatttttgttttcgctgaactctttgcttctatcgttgcaataactttctccgctgggtataataaaaaagaatattctacaacctcaaaggagggatttctatgatagaacagctcattgctgaagcaaccgaatgtgatttcaaagttgctctcgaaacaaaaaagccaaaaagctggttaaaaagtgtcagtgccttttccaatggaatcggcggcactctgtttttcggagtctccgatgaccgggagcctatcggcttgtccgatgttcaaaaggatgctgaagcgatcagccgcttaatcaaagaacgtatcacaccattacctcagtttatcttaaaaccattacaggaagatggtaaaaatctattagctctggaggtttctcccggccgcagcaccccatattattacaaggcagacggagtgatggaagcatatatccgtgttggaaatgaaagcgtaattgccccggattacattgtaaatgaactgatcttaaagggaaccaatcagtcctttgacaccttaacaacagaagctgtgaaaaaggattacagcttcacactcctggaggcaacctatctggaacgaaccggcctccgctttgagccatccgattatgtttccttcggtttggctgacaaaaatggggtcttgaccaatgccggaaagctcatgaccgatcagcacacagtttataactcccgtatgttctgtacccggtggaatggcttggaaaaaggctctatctttgatgatgcactggacgataaagaatacgaagggaatctgatttatctactgaaaagcggcagtgaatttattcgcaataattccaaagtccgttttgtcaaagaggcacagtatcgtgtagacaagccagattatgctgaacgagctgtgacagaggctcttgttaatgcgcttatccatcgtgattatattgtacttggcagcgaaatccatattgatatgtttgatgatcgggtggaaatcacatctccgggcggtatgtttggcggcggctcaattcaggaatacgatatttacagtatccgttcgatgcgacgaaaccctgtgattgctgacctgttccaccgcatgaagtacatggaacgccgtggaagtggcctacgcaaaatcgtcagtgaaaccgaaaagctgcctggatacacagaggcatataagcccgaattttcctcaacagcgacagatttcagagtcatcttgaaaaatgtaaactacaacttagagggtgacgcccaccaagttatccaccaagttacccaccaagttattgaactatcaacggtatccaaacagattttggctttttgcacaacaccaaaatccaagaaagagcttgcagtattttgcggcttcaaagatttaagaaacttcaccttgaagcatatcaatccgcttttagaatccgggcaattagaaatgactattcccgataaacctaaaagtcgcaatcaaaaatatattacagttcgttccgaataaacagagaagcagggcattgggtctcatctcccattgtcctgcttctttttcattccaaattatattcacatcatttacccatacacccaatcctggatcgcaaatttcaaactctgcacctttcccagcagccagatcgcagccagcggcagccccatcgggctaatcaaaaatgccataatcagcaaaattgcaccattctgcggggaataggtaataagcacagccacgccaagtagagcaattaccgtgctgagcagaccaagcaccagaccagatatgtagatcagccccatgcagagccagacaaaaagcgtcaacactaaaatgaccggtgcagttacaatcatcagcaagcatttcaaaatcttcattccagttcctccctccaacgttccagataccgtttgcacagggcatccgcttctctctcatcatcttccgtcaactcccgtctgcctttggtcagttcaatctccacataagtccggtaatcatcagctaagagattgaatagttccttgggagtatggcacacctcgccagagcaatagtgaaaatcttggtcaaattcaactcttacacatccatggcggctgatataaacttctatggtctcgtctgcggtcaggtaatccgcaaaaatctccagcaccttttcaaaggccagcatctgttttcactcctttgctacgcttcttattctactcatattatccggtacggacaggcaaaagacaaggatacagacaaaaagaaaaagcggaggaaggtgcggcgaagaaacgccgttcctccctccgcaaatggagtatctatccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccaactccttcagctctggcagttccagcttgaccacataaccatccagcgccattttccgcagataagcgctcaaattctctgtcccgtattgctgcatcttttgatggatcagttccagttcttctgcggacacccaaaacagaaccggcacatcccgcttgcgctttgccatggttatcgctccagctcccgttttttcggggcggcagacttattggcgggcagctcctgtttgagcttatcccgtactgagggacgggacggttccagtttttctctctgggtacggctgcgctgctgttcttcacgcaccagatcaataaaaccatccagcacagcagggtggctgtttaaggcataaccacaacggacggtttcgggattatcattaggaatggtcttggcccattctttgttgcgtcgggagtagcgcccatcccagtcctgaagctggatcgtgttagacagaaccatagatacacgctccatgccataggtctcgatcacaccctttgccgcatcgtggctgagatacattccgtcgaagtgttcccgcaccgccgcttcaatggactccttgcattggagatttacattgttggaagctcggtactgctccagctccccatgttctctcgcataggcagctgaatggggatagattggtgttgttcgcagttcctctttagctctgcacacatcgtcggcacggttctcaatgctgtcccggatcatatccatatagccggtctccagcttttcaaaataacggtacacatccgccagcggcgagggagattccaaaagtgcctgagcctgggtgtcggtcagctccagctcctccattgccatcacgatgtcctcgcggatggtgtactcataggcatggtttaagacttcttccgggggctggcttttcagccagtcccggaacttgtcctgttcggcagtcatcttttcaaaaagggccgtattcagattattggtattcatgttatcgcacctcctcatgctgttttggtttcttgtctgtactgcggggcgtcgccggacgcttcaggctgtccagcaccgagggccgcgcactcttggcaaccacagtttccggctgggcatgaccctttccgtcgatgttgagcaaagtatccagctccaccagacgggcatttttgcttcgcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctataccaagggttgcccggtgggtcatctgtcctttcagcaggagcgtatactcctgtttccatgcggaaaattccacggatatggcatagccccggtagctgccgatctgcaccggatcggaggttttgacctccttgcaggcatccaaaagggctgcgccggcgttctccttatcggtcagcagatcgccacggatttccataccagcaaaaccgtcctccgggtgcgggtgcgctgccaaaacctccagatcggattcaaagcccttgataaagcctttgtgcttttcaatctcctccgggaagtatttgagcagctggtcctccagacgatattgcttgctctggtggtcggctttcatcagcttcaggcgggatacctccacatccaaatccatgcgctctttgatacgtgggtctccggcacacaaagccttgatctctgcaaaactgagggcggtttcatccacatcatcgcaggagcgtaccggcgatttagaagtcatgatctgactaatgaatttttgcttattctccaccgtctgccagaggtatgcgtcaaaggttccttcggtcacatagcggtacacatggacaagaggattctggttaccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgcacctgaccggtacggactttagagaacaactcctttttccgcacttcggtgttggcttcatggataaaagcgatctggtcggcaggcatcccctgagcaatgagtttctgacgaatatcgtcatataccgtaaaggccggttcctgctccggcagaggcacagcgccttccaatgcgtgaagcagtggattatccaacgttttcgccgccttgcttgcaggagcttttgcctgcggtgtagaaatgtcgcagaacaccagctgggtcagcttgtcagctttgccgtcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggtcttgaccatttcctgctgatgttcggtaggctgcgccacgatgttgtggtattccacctccggggtaggcagattcaactgatcggcagtcttaatgtcggccacttctttgaacaggttcatcagctccggcaggttaaagaacttgctgaatctcgttcttgcccggtagccggtgccttccggtgccagctccaatgctgtgacggtctctccaaatcgggaagcccagcagtcgaagtgggtcatgttcagttcttgcaggcgttcatactgaagataacgctgcatggtgtaaagctcggtcatggagttgctgaccggggtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcgaaggttaccacatcgtcttttcgcccctcggcttgcagcttttccagtctggcttccagagactttctggtacgctccagctgtttgacggtgaaacgctcgccgccactggcctgtacctctgcaatcccctcagtgatctcgtcgatctgttcatagagaagccgttcctgacgctcccggctgatggggatacgctcaaactggctgtgtcccatgataatggcatcataatcacccgtcgcaatacgagcgcagaacttctttcggttatgggtttcaaagtccttttttgtggtgactaagatattggcggaaggatagagacgcagaaactccgacgcccactgctcggtcagatggtttggaaccacaaagagagatttctggcacaagcccaggcgtttggcttccatcgaagcagctaccatctcaaaagttttgcctgcgcctacttcatgtgccaacagggtatttcctccatacagcacatgggcaatggcgcttttctggtgttcccgcagggtaatggccgggttcatgcccccaaaagtgatatggctgccatcatattcgcggggacgggtagagttcatttcttcgttgtactggcgcaccaaagtctggcggcgctccgggtctctccagatccagtccctaaaggcttcccggatcgcctgctgtttttgagccgccagggtggtctccttggcgttcagtacgcggcgctcttttccgtctgcgtcctctatggtgtcatagatacggacatcccgcaggttcaggctgtcctccaaaatcttgtaggcattggcacggctggttccgtaggtggtataagctgccacatcgttgtaggatacagaagatttccccttgatctgccattcagcggtaaaggacgaatagttgaccccgatacttcgctggagataaaacggggtattaaaggtctcatacataaactgctggatatattccttgtcaatccaggtagcgcccagacgcacctcgatctccgacgcatccaggtctttgggctgggcggcggtaagggcttccacattgactgcataaaccgggtcctgctgtgcggcccgctgcgcctgacgcagtttgcggcgtacattgccggagaggtattcatcagcagtcacataatggggtgtgccgtctttctccagctgtcccggtacacggaagattacgccttgcagctctccggccagttcttcttttgtttttccggtaagctggctcatatagcccatatccacgcaggctttttccgagatggacaccgccagtgcttcacttgccgtatccaccacagccaccgcctgatggggcttgatggtccgcttggtgaacatatctgccttgcgttccagctttccgtcctcgtcgatgacttccaacgcacagagcaggtaataggaagaatcgtctgcataggccagacggtttgcacggtcattgatgagaccgtatttggaagaaaagctgtcatagaggctgttcagttccgcctgcttctcccgaatggtgctgtccggaaccgctgcatccatctgaaggtcgatcagttcctgcacacaatcacgcagtcccacaagaccttttacacgggcttcggcggtggcgttgaggtcagggcgcaccatacggctgttttcccggtagtacacctgcccgtctacaatggcataggaatagttcttcacattggggtcggcaggaatggaggtgtcaatagcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccgagtggtcgataaaataccggttgatggcaaatccgtcctccgtctgtccggtttgagtccattccggcacgatgtccagcgggcggtcccgtttttggaggaagatgatgtccgatacaacctcggcaccggcattctttttgaacgcgtcattaggcagacggatagctcccagcatctcggcacgctgggcaagatagcggcgcacggtggaatccttggcgtccatagtatatcgggaggttacaaaagccaccacgccgccgggacgcacctggtccagtgctttggcgaaaaagtagttgtgaatactgaaattcagcttgttgtaggctttgtcattgacctgatactgaccgaaaggtacattgccgatggcaaggtcaaagaagtcacgcctatcggtggtctcaaagccacctactgtgatgtccgccttgggatagagctgctttgcgatgcgcccggaaacagggtccagctccacgccgtacagacggctgtttcgcattttctccggcagcataccaaagaaattgcccacacccatagacggctccagaatatttccggtctcaaatcccatacggtccaccgcttcatagatggcctgaatgaccgtagggctggtgtaatgggcgttgagggtagagcttctggcggcggcatattcctccggggtcagcagttcttttagctgggcatactctaaagcccatgccggtttctccgggtcaaacgcatcagagagaccgccccagcccacatatcgagaaagaacctcctgctgttcggggcttgcctgctgtccggcagcttccagctctttcagcaaacgaatcgcattgacatttgcctggaacttggctttcggaccgccctcacccaaatgctcatctgtaatgcggaagttttttgcattgcggcgcaggttagccttgtattcctcataagatgcttcctcggcagctttggcattgggaaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccatggtctcggaatggaaggtcggggattcggtagctggttgggactgttcctgtccaaaaccgtcctgctgacgggcatacatcccgcgcagcaaaggcgcaacctcatcccagcggaaatacagcatagccagacgcctttcctctgcatccatgacttccagttctatgccctgtgccgtggtacggtaatcggcaatatcgccggtctccagattcagtgtctcaatctcaccggaataggctctgctcagccagtaggcgatctcgctgttgctcctgccggattgcagcagcgtggaaatctgctttttatccgcttcatccatcagtccatgagccaatacatcccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcagcagggtcataggatgttctttgcggagttgggcggcgaactgcatcatattcctcatcggaaatagcaacttcggaagtctgctttgtctcagcagctgcgatctgctctacatccgacatcacctgttggataaacgaatcattgtccagtttttccgggtctgccacctggccgttgacgatccctctttcctccagagcttcccggatggcgattgggtcgatgtcgtcaaaacggtcctgttcttcttcggtataaaaccgttcctcctgaatgagctgggcaagcctacgctgtaccttcggccagggcagctgcgtttcctccgggctgccggcacggacaacgaacaggctgttgctgttactgccgcggtattcctgagccagccatgcggcggtatctttttctcttgcatggtctttcatatagcggacaacagcgtgtttactctcgatattgccgttccatgcacaaagggcagtatcaatatcttcctgagaaagagggcgcagaagctcatggagctttggataggtctcgtcgatcacttcccggtgtaaacgctggcggaactccggcacatccgaatagagtcggatcagctccatatccttagaaccaaggactgcacggcgcacagcggcattaccctcgatgacagcattttcacggtcagaatgaccgcaggcattgcgatatgcggtatcctcggaaatggcgacagtcaccacaggcttatactgctcaaactgctccccaagggtaggctttggcgtttcttcctccatctccggctgctggacttgaatggcatcttcttcggccagttcctgttcagactggatcttgtcatactgtgcctgttcctgttcggtaagatagcgttctttctggacaagtgaggtaatgcgcttggcaaccttttcccagttcaagtgaacatccgggcagtcctgctttttatagtgcagtcctttcccatcgtgatcttcgccgctgtgtgttgcgccggacagggcatgagagcgtccgccaatgccatactcgtctttgaggaatctcactttctccttatccgtatggtttgccatgaagaacgcatagatacggccttttcctccggcgaaactgcttccgccggtcatggcggcgtcgatctcatcctcggtaataaagtgctggacggttggcacttgggaaagctctgaagaaaaggtcctgcgtggaaggtcaaggtccttcaggttctcccagatttcccttggcctatggtagtgaaagcgcaacagatcacggtcctgctgataggcagtcaagaaggcagcgtattcttccttgagggtctggcggaaagccggttcactcagctgctccatcaggcggcgggtctcctccgggaaaccattgcctttgatttctgacaggcaggacaaatatccggcttctctggcttcctcgctgaaatcgtggtacagataccagagcttttctgaaagaagggagcgttcatagcctgccgcttctgcaagctccacattggaggcaaactggccgctctccaaaagctccccgatacgctctgcggcgctctcccaggaaatgacctgggcagacctgtcataacggacagacttcccatgtgaaagatggataccatcctcggcataccatgcgctcacactgccaaggccattgccgccgtggtacagcgttttcagtatctcggcaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatggattggatctgttccgcttcggagaggaacaggtttagggtcagctgttgataagctccgccatcaggatctcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacagcttttcgctcagcaacatctggttgtagaggatgggacgatgttccttcaggtaggttttcctcatcctgccgtacttgcccaggggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagattgccatgaaatcttcgtggtcgaagtagcgttccggctccagtccgcagcgggacatcaaagcgtaagtgatgctgacggtggctgctgccttgaactgtactccgatgttaaactcatcatattcctccaaaaaggaaccgtcaacgatatagaagaagtcctgctgatgctccgtccagtattcctcagccagttttccggctacctcggtgagctgtccggcaaggtcatcaccggaaacatcataggtgcgctcaagcatggcctgcaccgaatccaaatggcgctcctccagctgccacagccagggagtgcgggaatgttcacgagttccggtgtcggaaatatcaaaaacatagcgcaggcggggtctgtccccggaatcgtccaccagagcgattcccttggagccgcgccttacataccggcccatcttttcattccacaaatcgtactctgcacaggcggtagcgtccgggcgctgggcgtagatcatcaactgctcatggaatgggtacttgtaaaggcgggaagcagtagtgagaaaccctgcccattcctgccagctccccgtgagctgcgttgtcaccttctccgccatctgtgcatatagttcagctttggttggcatagtgttctgtcctcctttcggtttttgggtaaaagaaaagcaggaaacctaaaagatttcctactaagtaaaactgtgagtattaaattattattggttatacaaactgcaagttatttttctttatagatcagttgtcatttcacacataatgatacctccgtcaaattcaaataatcacgtgctttcagattcaacagaagcctatgatttgatttccagaaaaaccgcaaatctgcgaaagaaccttatgtgaacgtcatatacatccgtcagcatgttaaccatccgagcatgtgaatgtataacctttttcaatcattcgcttctcatgttcagtataccattttttcgcataccattcagccttgtcttcacccggaacgaagactttagtgtacccgtctttatctcccacaatggatgaagcaaatgccgtttctggacagcctgtgatgttcccagcgtcatacttcaaaattatgttctccgcgattgagtagtaaaagacactggcatcagatttatacagaccatcctttgaaagaggatagttcttaaatcgtatttggttatactttggattcatgccatgaacgagagccttttctgcatcaaggtttatctggttaggtgttacatcaaaatccccagtgagtgctttcatccagtcattctctgaactgaatcccgtgagcatcgtacacatataggaatcgatggtaaatggcatcaatataagttcttcacttttatcaaagctgggtgatattactttctcttctataagcatatcctgtagggcgtgatgtgccttaaacctctgtgtcagattctccccgacacactctcctacataaagaacctcataggtaattgctggggtaaaatcgctttgcatgaaaatttggaaccagtcattactacaataataaatcagttcatcaaaagtaaatccaatagtggaaacagcttcacctttatcattaaaagcgaacagccatactttctgcgctttctccaagccctctggttccgtttttattcctgcaaagccgttcaaagagtattttgaatttgtcgatgcggggatgaagatacggaaggatgttttacccacctcagcgtcaaggattaagcaagattcatctgacatttcccttcgtggaacgaaaactggcacttctcgtttgcctatgatatagagggaagcattgtcgaggctttctttctcattccagagttcaggatcgagtacaggtgctttctttatacggttgaaatctttgatagagataggcgcgtgagttaagtgtaaatttgtttctaatatattgttcatattttgttccccctcaaacttgaagttgtctatttctttaatatagcaacaatcataaatatttacttgcttcccgaatactcaatttatccattttatccttgtaagtctcaacgaaattccttacccaatcaggattggtctttgaatagtccctcaaactccaaccgattgctttattgataaaaaattcagaactgccaaaattgtttaccaatattttctcaagcaactgtgtgtttgttttatcttttctgcacagctgatggtcaatagcaattcttcgcacccaaaaatcatcatctgttgaccattcaagcattaagttgtttattctctcgtcaaaaaatgctatatttccaacaattctgtccagcccatctattgtatcccaccattgatttgttttaatatacttttttatgtgtggaacatcatcatatgttaagaattcctgcatcgctacaagataatccatcacaaaataatggaattccctatgttcgtctgcataacatctgtcaagcaaatcccagtcaacaaccttttttgttttttcggctcttagaaattccttatagatggattttcgtttcggtgttggtaaaccataaaatacaaacagatttctcatatatgctgccatttttgtggcgttttcatcatttctatttgcttcaaatttctcttttagttcattatatttgtccatctctgcttctccaaattctgatttgttgcttacattatagctcattcatccctccaaatatagtaggagtttgtaaagagttgagagaaaccgccttcccatcgaacagtttctctcactatgtcatcccgacacgataaatttactggtcaaagtccgggtacaattccaattccgcaaattcatcatccgtcatggtttggagcttgcaaagggcgctgtcggtcagctccctcagttccgtttcctctggcgaaagctcgccgcgcatctcacgcaggctgtcgatcaatccggtgcggctaccggtattgtaaatgcacatcaggttcatttcctcaaaagtgaagtttcccatatcaaatctccctttccgcactctttttgggcgctgtctttttgtgttctgccttgggctggcttttcagctgctccatgacggactttttcttttccccttcctcccgatgggcagcggcagccaaatccatgagggaaatggactgaccgctgcgggcctgctgttccagctctgccaccgtaggctcttttgcgccattgttgatgataccgtcgatcatgccgtaatcgtcctccacggccatctccgcatttttcagcggattttccggcaggaatccggggatctgggtaaaaccaacactgtcacagtaatgacaggataccttaccctcctgcttgatcgcaacgatgtcactgacactcatagaaggactgtgaaaatccgccggtttttgcagattaaactgctcatatagtttttccagctgctccggtaccgtgccagactccctcagcggagcagtgtaaatgagatcataattgctacggtctatggaaatgtcatgggactttagccagtccagattcataaagcgcacattctgcggatcgtcacggctcacctgatagatggcaaagcaatctctgttctgagcaagaaatgcctgttcccgttcctgctgatgttcctggcgctccatgaccttttcgtggaactgagggcttttctcccattcctcacggtccacaccgaaaatgccgccatgatccatgatctcctgtgggtcaaacaccatgctctccgtattgtcctcatgcagcacatagacagtcaaaccagcggcatccagttccagcgcccgttctctggtgacagggagcatcccatcatagaagtagccgtattcctgcatatccggtgtggatacctgctcatcaggcatagggtattcatccagcgcctgctcttgtgcttccggcagctgagaagaagcagccatctgactggcctctgcctgcatctgctggtaggcagcttcctgcaaggtctcaatcatggacaacggtgcgtattttaccgagtctctgcccaaatcgttgtcatcacaaatctggagaactgccttcatgcgggaaatctccggcatatccagctgaccaccatccaactctttcatggacgcggcatcgtaaagggtatagtcccagccgctgtcacaggactggatatgaagataggtggcatcgtcaatcagaaacaaagcctcctgctggttggcatccgcccccagcacttccatttccggcattgccgcagccagttcctttaccgctttttgcaccagaggattatcacggtaatagtcgattgcctggatggtgtccaggtcaatggtctggccggtcaaaatcggaaaaggtccttcatagtcgcttccgtctttcagctcaaaaccaatgcccttgatcccgttcattcgctctactggaatctcctgataaatgcggacagcttcctccaaagacaggttatcgtggtattctccgaggtttggaaattccatgcactctgctacatagtaggtcagatcgccggtcggcagcctatcagataccttaatggcatctgctggctgctctatcggggcggtttccggctctacctttgcatgagggtcgattccgcgctctttgcagatttccttatagtggcgctcaatgtcggagatcaaagtgccggaggttttgttgatggtctccaaactggctctcaactctttcagttccttgccctgactccaactggcaatatagccaaagctattttctccagtctcgatgccaaaatatttgcagactgcataggagatgctttcagcctccacttcttccgtgtgacggtttttgattgcctgtttttctgcggttgcatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcatgaaccgtggccgaaactgtctgcacctcactcatgccctgacgaatggcaattttctgatgatcagcagaaaaatagccgtccgtatcagcagccattgcttcaaaagtaatcggcaccggtgcgttgcggcgcagggcctccatgaatgcctcataatttggcacattgccggaaagggatgatgcaagctccggcaaaggtttcccgtcggtctgactcacatcaaagaccttgacagggcggaacatgggaatctcgatttctttttcctctgtgacgatctttccgtctttatccagaatcggagccttggtatctgggtccagcttctgctcctcgattttcttcttatacggtgtgggagcgatgatggtaatgccatgctcgcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttctgcaatccatgccttttgttcttcttcactttcataaagaaaaaggtccagcaggtattctacataggctttcttctggattgcttccacaaaacgggggtgcggttcttcctccggtgtcctgggagaacggtcggcttcccattttttcagcagatagtagtaatcggacagtacgcgataacagcgctgtcgatcctcccgaaacttctgtgcctcggttttttgccggacatatctcctgcggggcggggcctgactgtcatagatcaggccaaagtcctgcgccagtttctccgccgcttcttttggggagaggtcaaagagctttgcggtaaagtcgatcacatccccatcttcaccgcagccaaagcagtggaatcgctggtctaccttcatgctggggttcttatcatcgtgaaaaggacagcaggccatgccatttcgcctgacttttatcccataaaactctgccgcttctctggtgctgactgacagcttgactgcttcaaatacattctctgccatgtgcctttaactgctgggctttctcacaggaggctggtatccggcagctttcgcacgctcactggcagctttgcggcgctcggcgctgtatggctccctgactgatacacaccgcttggggacggtaaagttatgggcgtcctttcgggtgatctggtcggggtgcttttttgccagcagttccagcttctccatcagacggggatcgtgggtgtagacctcagccattggttctgcctggttatagaggagaatggtttcccgttccactaaagagagcttcatcggctgcctcctttccgctggtcaaattccagcttgaagttggcgtactgtccatcatcctccaaaaccacagcggcatcgtaggtctttccggttttctccgaatatagccccgtcacacggacacagccatcgttcagcagcgcagacaccacagctttggtcggctgttttttcttggcagcccaccatttgttgtttttccagattgcaaatttgcaagaatcattctgacagaagaagcctttttgcagttctgcaacttcaccgccgcagcgagggcatttgcccaccacctcgcggggcggagtgaacaggtactcagttcccttgatgacctgataagtccccaccagatctttcagcatggtgctgatcccgtccagaaactcctccggggcaagctgcccgcgctcgatctctcccaggcggtactcccactcggcagtcagaagcggcgattgcagttgttccggcagcaccgtgataagggatactgcatcgtgggaaggaagaagctgcaccgtttttctgttcttttttcgctccagaaaaccggcagataccagcttttccaaaataccggcacgggtggccggtgtccccagaccttttctctcagcatcctctggcatatcatctttcccggcagtctccattgcggacaatagggtgtcctccgtaaagtgctgaggcagactgcttttgccttctttgacgattgccgcagaaaccgaaagtgtctgtccttcggtcagctccggcagggctttctctacgccctcttttttcggctctgtatccttcattttggcacgataagcgtcctccagtgctttccatccgggatgcttcactgtttttccttttgtggtaaactccccaccggcacacgctgcaatcacaacggtttccgaatagatatggggctgggctacggcgcacatcagacgcagggccaccagctccagcaccgctttttctcccgcaggaagggcagaaaggtctgcatccttgagatttctggtagggattactgcgtggtggtcggttactttcttatcgttgattaccgtctgcggatcacaggtaatggcgattcctttgcgaaacggcatagcattggcaaccagattgaccagcaccggcaggctgtctgccatatcgccagtcagatagcggctgtcagtacggggataggtgcagagctttttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttacaccctgacaggcttctttcagctgctcagcagcagccttatccgccatgcgctccccggatacggtaagaccgggcagctccagcgccacggtataaaagggaatcggcttaaaggtgtcgatctcagcttctcgctgaacaataagcgccagcgtcggggacatcacgcgcccgatgttgagggttcggtgatacagcacggaaaaaagccttgtcgcattgatccccaccagccagtcggccttggcacggcagagggcagcatcccgaagtccgtcatagtccgcaccggggcgcaggtttgcaaagcctttccttatggcggagtcctccatcgaagaaatccagagccttttcatcggcttcttgcaacctgccagctcatagacgctacggaagatcatctcgccctcgcgtccggcatcacaggcatttaccacttccgtcacatccggggcattcatcagctttttgagaatatcaaactgctttttcttatcttttcccaccaccatctgccaatgttccggcaggataggcagatcatcatatcgccacttggcatactttgggtcatagctgtctgcatccgcaagaccggccaggtggcccacgcaccagctgacacgccagccgttgccctccagatacccgtccttacggacggttgcaccgatcacagccgccaaactctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatacgttcatagggactgtctgtgaaacgggtcatttcacactgtcctcatcatcttcttctgtgctgcccccgtcagcatccggttcttccgactcctcatcctcggtttcccattcctcggaatcttcctctccataatcataatcgtccagactgtcattgcccttggtcttaggcttattcttaacgagcttcaagtaggcaaatacgccaccgccaccaagcagagccagcaaaaggactatcgcagccgggttcaatccggcaggcttctctttttccggctccgacgtttctgccggaggttccggtgctttgcccgtacatttactcttatcagttgcgcagaccgggcaggccgtattgactgcccctgcttcacattttgttgaacagctgcataccgcaggcatctcctctttgggttttccatcttccatcagcgccgcaaggtctgcatcgtccacctgattcagaaagtgaacagcagtctccttgtcctcattcgccctatcaatcaggatgtaaaagtaatttccagctttggtcgtaacagtaataagctgcttattgcctccaaaatcatccaccaatgccgcattcccctccggtgtaagtgccggtgccggttctgtttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtaacctcctgattatttgattccgacagtgctgtatctctgccgtggttcattccaccggaaagcatagcgttcagctgtgctggagtcatgcgtaacgcacgaaccatctgaacgatttccagattctctgcctccgttttctgtgcttccagggtcttgagcttttcctgatattccgcaatcttctcacgggttttctcaatttcctggtcgatacgttcaattttattttttgccataaccgttcactcctttccacaaagtctgttaccagttcatcaggccgtagcccttaatactttgataattcaggtcataacttttgatcttgcaggcatcgccggaatttccctccaccgtataaacacggctgccatccgtaccgatcacgatacccacatggtctgctgtcccatctaaatcccaatcaaagaaaattgcatctccgggagccagattgttatagcctcttgcaccccattgtccatgagactggaaccacggaacgccctgccactcacagcctgcaaagcgcggctcactttttccagcctggttataacaccaggatacaaagcaggcgcaccactccacgcggctgtcaaagccataccagctccaataaggatagccgcccacattgccgacctgacgcttggccagctccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggcttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgcctgagcgctctgccgggtgtaaccttgcaagacggcagacagaaatgctgccagctcatgagggtcatggccgatcataccaaggtcatagcgatactcgtcataccctgggtggctgctttcaatgttgtcgatttcctcctgcaactggacttctttggctgcataatctgcctccactgccagcatttccgggtcatccgacggataagtggtgccggagagaacggaaccgatgctctgcgccatcatggagcaggaggacatggtattcatcagcatacaggtaatgaggaacaaaacccctgccatcaggaaacccttcttgtggcgcacgacgaacgcccctgcctgctgtgccttttctttcaccgtccttgcggcttttccggttttggacgcagcctgggcggtatttccggcagtctgaccggcgtgtttggcggcggcatactgccttttgatggcctgcttttgctgccagcgggaaagcggattgctggcaaactggggattttcctgcaaagatttctggtacagaacatttacatttgccttttccagttggcgctctgcttgggctgctttgcggtacggcttcagcttgtggctgcgatagccctcccgcaccagataagcgccggtctccaccgcttcctcggacttgtgggcgctttccacgcccacattgtcctgctctgtttcccggatctctttgtggagcttgcctgcgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggatcggcttttccagtgcaggatcagaccgttcctcatcagtaaagcgcaggcgcggctccttattcaaaccattctcccagcatgagggaggacatcatgtagtgcagctctgcataaatggccattcccaccggatcgttgaacatacagccggacaggtaggcataaaactgtgccaccacatcggacaggatcttcgcttcggttccttccagaaccagaccgcccataccttccttggcacggatggtgctccagacctctgccagacggagtagccccacctgaccggtctcattcagttcggctgcctgatctgccgccgtgcggcactcacttaccgcatcggccatgactgtaagcagctggctgcgctgggcatttaccgccctgtcaaaaaacatcagcggattcttattcaaaatgttggggttcatcatcattcatcctccttctttttcagttcctggggtttggtagtcataatgcggtaaagttcggtgttcttcgggaagtgatccacaaacggcaggatcgtggagccatagaacagcaggccctcgccctcaccggagtgggtcacatagctaagctggtgcgtggaaatccccagttgcttcgccaaaatctgacggtctccgcctgcctggttaagcatatacacgaagtccgagttttcaaagatgttctctacctcgcggctgctcaaaaggtctttgacattctgggtgatacctgtcggaataccgccccattttctgaatcgcttccagatttccaccgtataggcggcggtctgctcctccttcaaaagcaggtgcatctcgtcgatgtagtaacgggtggacttgtgggcggcacggttgatggtaacgcggttccacacctgatcctgtaccaccagcataccgatttttttaagctgcttgcccagttccttgatgtcgtagcagacaatccggttatcaatgtccacattgctctgatgattgaacacattcaaagaacccgttacatagatttccaatgccgttgcaatgtactgagcttctttttcttcctgctcccgcaacaggttataaaggtcctccaaaatcggcatattctccggcttcgggtcattgagatattcgttgtaaaccaaccgtacacaacgatcaataatggttttctgcaccggctgcaagccctccttaccgcccacgatcagctcacacaagctgaggataaagtcagacttgagtgacagcgggctttcatcatccgaatagtccagattcagatccatcggattgatatagttggttgaagtaggtgagatcttgatgacctgcccatgcagacgctccaccagaggtgcgtactccgcttccgggtcacagataataacatcatcactggtaagcaaaaagcagttggcaatttctcgttttgcgctgaaggacttaccggaacccggcgtacccagaatcaggccgttggggtttttcagcagctttctgtccaccatgatgaggttgttggacagagcattgataccgtagtacagagcttctttcccgttctggaacagttcctgcgtagtaaagggcacaaagatagctgtggaactggtggtcagtcctcgctgaatctcaatctgattgagacccagaggcagacagctcatcagcccttcttcctgctggaagtccagcctggtcagctgacagttatacttctgggcaatagagcctgcctgaaagatgttgttgccaagctgacggggattgtccgctgtgttcagcaccagaaaggtcaaaaggaacattctctcgttgcggctctgcaaatcctgcaagagttttttcgcttcactgccgtaggtagcaaggtcagatggaatgatgtccatgtcgtatccggcacggactgcttttttctgttcctcgatcttgctgcggtccaggtcggtaatctttcgctttaccgttttgatggctttcacctgatccaccgactgaatgtgcatactcacaatgagcgaactttccatatccagaaaatcagccagcaaacggtcattcagctccggtgcgagaatctgcaaaaaagaaacagctccgtatttcttacccatacggaactgcttgccggtgcggaactcaaaggagcttggtgcaataaaatcctttgtggacagaccagaaggagccagccagtcccattcaaactgaaacgggagttgttcatccatgtggaataccgcatgaagctgaaaaagcctttctttaccgtccagcgttctggcagctacaccaagacgcttgaagttattaagtatatcggtctcaatacgctccagacggggcttggcggctttgatgctgtccgcgtcgataccaaaggtcaggtatttggtcttgatgagaccgttgttacctctggccagctgattttgcagcattgtggtgtattcctcgcggatactgtcaaaggcgtccctctggggcgggatggaaatggagttagcaaaggtctcctccgatgccgcaaggttcaaaaaagacagctggaaatgaatcgagctgtcaaaataattgaggaaatcacaccacccctcaaagattgccgtcttatcttcgttttgggagagctgatagttgatgtcctgaaactggatggtctttgtgtagtggctgtccgatatgcggcagattccgtccggccacatccgttcataagggatactgtcctgcgcagattttccttttttgtccgtgcggttagcgcgggcaatggccgcttcgatctgcttcttatcggcgcgggacagttttttctttgtctttaccggctgcacagttttttcctcggtttttccgaacatccgatgcagccatttttttattgcggtgaacaatgtcatacacctccttatcgagcatttcctgccgctttaatacggcataaaagttgttggtctggtaaggtcgctgctttggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtgaagcagataagctgccgcttggtcagattgaacatgacctttgttttgacttttgttaagtccttgggtacgggtacataagccaatgtggaaacctccttccgttttagtgcgcctgaaagactgatttggcgagactgccggttttgaacagcgtaaaacatagcagtacagtgtagcccacgcagctccagattgccatgatgatgtcatcttccatagcgatgttctgcaccagcacagcataaattgccacgcagacgataatgagaaacgcctgaaagcccagtgccagcagggatcggaggtaattctgtcccataccgccccattctttgcccatcattgcagccattggaacgggagccaccgaagttacaaggtagatctcgatcatacggccataaataacgataaagatacagatatacaacgcccacatggtaatgccaataaagagggattggaaccacagtccgaacagcggtcccaaatccatttccatcagcctcggttccaaatcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcataacgatagccaggatcacacctgcaatcggcaccatgatggagtttgacagattctcaatcatattgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcagagctgcgggagcggcaaggatttcatgcaggaacgcttagacagagaacagcccggagagcagaggtacaagaaccataccaacaacggctacaccagcgccagccatgagctgttttatccccaattaggtgtaaaactctgctcgatggcgggcggcggcgtacaaaaaatctatatggtgttgttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccaactctgtgatgttggcgtattcctgaatggcttccacccattgttttgcgtcattggcaagctggacttcatcggacagccgctttctgccctcagacacttttgttttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcacgctgctcggcttcacaggtattggtcaggcggtcggcaaccgcttccccgtccatcagggcagctctggcacattcccggattttccgcagtacatggctgtaaagggtgtcataatcaatccggtgctgggtgcagtggttctttccaaaggcattgtaggtcttgcaggagtaaatctgctggggatattttgcgtttgtgtagcgtatcgtcagcgacttcccacactcgccgcattttatcagtccggcaaacaggctgatttcattggtctgccccggacgctggcgggatttcagcttgttctgcacaatgtcaaagctcatgcggtcaatcagcggttcatgctgtccctccaccacaatccagtcctccggcttcttttccccaatcgtgccgattttgaagcggtagtcctttttctgggaagcaatcgccccggtgtagacgggattcatcaaaaggtctttgataacggagaagtcccacatataccgcccgttttccgggtctttcttttcccatttggtgcgggtattgcgaagcccccgttcccggttccaccatgtagggcaggggattttttcttcctccagccgtctgcggatatagttgggaccatgaccgttcagggcatatccgaaaatcagccgcacaatcggggcggtttcctcgtcaatgagcagatggtttttgtcctccgggtctttccgatacccaaagggggcaagacacccggtaaactgtcctttctgcgctttcagaagataggaggaatggactttcttggaaatatccttgctgtacatttcattcaggatattcttgaacggggcaatgtcgttgttatcccgcagggtgtcgatgccgtcattcatggcgatatagcggacaccgtttcttgggaaaaagtcctcaatcaaatgcccggtttgcagataattacgccccagtcggctgaggtctttcgtgataacaaggttgatctgcctgcgctcaatggctctcaacattctctgtaggtcaggacgctccatgttaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgataacccccggcaagtgccgaaccgattgttctgtattccatttcgttcatcatagccatttacccacacaatccagacggtatctggctcttttgaacctcatcttcattatagcctatatctttctttttagcaagatattcttttgcatttgtctttccgtatttctgggaaatcaggctgacgaacacatcagtggcgtcaagctccccgtcaaatacagtggtcacatgaatctctgttttgttttttgccataggcagttatcctccatacatgaaaatagccagacagagggtgtcggcaacgaagtccggcaacggacttcaaaagaccttgcaaacaatctcaatctggcgatggttactatttatacttttcttttatttttttgttgttttggttgttataagggagaaaagcccggaaataaggggtttttcccggcaaccggctcggcaacgggataacaacagggggtgcaacgggctgtccttttcagaatggaagctccatctgttctgtgacctccacaaaaccgtccatcgttttttcagacgggttgccggagtccgttgccgggttttcacgctcccagcccttttgtctgccatattcggaaaacattcttgggtttgggaagtaccgccagctggaaatgcactggttcataatctcgttgatttcccggatttcccattgcttcggctcgtcaaaagcatggttcaaggcttccttatagagctgcttggagcagaccatgctcccggtgtatttatcaagatacgcctgtatcatcccggctttggtgtcctccggcataaaatcccgctggtgttctttgagataccgctgcatggcggggctgaaagccagcttgaacctgccgcttttataaatctccatcgcttccgcccacatctgcccgatataggctctggaagcggcttcatcctccaaaatgtgaacttccgcctgctccgggtacaccatgaccgggataaagcggcggttgccggaacggtcaaggggcaggaagtcaagggcattggaagtgccgccaaacacgcactgacgggggcggtctgccgggtgggtttcataaggtatcttgtagacctctttctgccggcttaaaaatgacttgatttcctcaatgctcttggcgttggcggttgccatcatttccgacatttcaataatccagtgaccttgcagcttgcggtacacattgtcatcgtccagcttccgcaaatcatcggagaaccactcgtcccggactgccagcagccggaagaaggtggactttccagccccctgaccgcctaccagacagagcatgatttcaaacttgcaccccggctgaaaggctcgtgagattgcacccagcaggaacagcttcaacgcttcataggtgtaatcgtctgcgtcagcccccagaaagtgccgcaggcagaagcggattcgctctgtcccgtcccacacaagggtattgagatagtcccggatgggatggtacttgttttcattcgccacaatcccgatggcgttatcaatctttttctcattggtaagcccgtaggtttcttccagataaagaagcagatacttcatgtccgtatcgttcagggcggtgctttctctgtgaaaaccgatgggctttatgatgtccttgcggtcagtcaggatgttgtatgcgatagcccctgaaagcagagggtcacgttggaatacggtcaggcagttccgtatgctctgacggacaccgcctttctcggtggtttccagccccgccttgatttcctcaacgctctggggcggctgcatggcgttcatagtgttttttagttcttgctgcgtctgcggctgcaagttctgccattcgctgttcaagctgtatcacatcctttccgtagtccgtaatcaaatccgctttttcctctgtttccccgaacagcagcacatccagcagatattccacttgggcttgcttctgtaaggcttccacaaaccggggatgaaaggcttcctccggggagtgcggggcgtagtccgttctccatgccatcagcagatggagataatcggcaagaatacggaagcagcgattctttgcttcctgaaactgttcctccggggatttctgccgggtcttgggcttttttacctttcccggcggtttccagtcctcataggaaagcccgaagtcctgtgccagctgtacggcggcttctttctttcccagcccatacagggcggcggcaaaatcaatcacatccccatccgcaccgcagccgaagcaatggtaacgccgatccagcttcatgcttggggttttatcgttatggaacgggcagcaagccatcccgttccgacctacatggattccataatactccgcagcctgtcttgttgtgacggactgcttcacagcttcgaatacattcaaatctatccctccttgaaaataagaaaagcacctgacattctctaattgaaaatggcaagtgcctgttaaagttccatatcctgttgtctgtgtttctcctgtgccggggcggttctttgtgcttttttctcgtcagtcttatcctgcaagacttctttgatgggctgcttcttgggcggctctttgctttcctctgtgccgggtgtggctttccgtacccagtagcggatgtcccgcagcttcttcaaatcctcctgtacctcggtcagtggtactttcagctctgcgatttcgctgagaagcgtttcctgctcctgttgcaactcatttttcgttttatccttatcgtccgggtgcttggcaaggtagtcagcggctttctcataccgggcaacctccgggtgttcctgtttgaatttcccctttattttcttaaaaaatatcttctggtacttctcatagacagccttacattccttgcagtctgtccggctggcaagaatcccgtcaatcactttgctccgggcttcctttggcttcatctgattgcggtaatctgcggctgatttcccggaagattccagaaacgcttctaagtcctccacagtggaaagccccttttgccggagataggacagggcttcgctgactgcctttaagtcctgtgaagttccccggttctgtccagcccttgtccagtccttccgttcttcctttcgtatctccatatacttcatcagcagattgggaagaagtgtcgcttcctccgccgccttttgtgcaagcagctccttccgtttttctcccagctcggtaatccagcctttgaggttttggataagctgccggatggacttcatcaggcggttggcggctctgatttcccggttcaggttgccgatattcgtctggatacctcgcttttccatctgccggacagcagtcccctcatggacagtggggactatatcaagcccctgtctggcataggaacgcaagtccacacgctccgggcggtcattggcgtccagatagcggttctggataacctcccattcatgccgccagatttcacaatacttctggtcgttccagtccaccgtatcctccttgtggcttttccacctgccggacggcagctttatccgttccccattctcgtcaaggtcataaaccttgcggctcttgggaagccattttccatgttcatccattgcccgcatggtcagcaggacatgggcgtggggattgtgtcccggcggatggggggcatggatggcaaaatcagcaatcatgcctttggaaacaaactgctgttcacaaaactcccgtacaaggacagcgtactggtcgggcggtatctctctgggaatggtaagcacccaccgccttgcaagctgggagttccattgcttttccaccgcttcggcggcattccataaagtattgcggtctgcatattcctgtggagcatttgccgggagcaggatttcattgtggacgataccacgcttttccgggtagtgctttacttgctggtcgtattcacagaacagcttttcgccgctttggtaagcagcggcggcaaccgcagactgccgctggctgcgctgaacaatcgtgatttcgttgtgtggacaaggcatttcgtgtccctcctttcgctaattggtggatggggtggcgttttaccacctcattttgggcagaaaaaaagcaggagacctttttcagatttcctgctcggtgtgccactgtgtgagcggcgggtatttagttgtaaaagttcgggacaagttgacccgatgtaaagctaacaaactggaattgcaccaaaacaatctaagacaacaacgctgccctacttgcgattttttcttgtactgcggaaacagtttcttgaatggaataagtggtcgtatctataacattcgattcatatattcccagattgcaaaattgctcccacatggtttctaccaattcgatatttgtctttcggtctaactttgagcgttcaacagctcgcttcaaggtttcttccttacttgcccttaaaataatataatgcacctcataatgttcccgaacaagactttgccacggctttaaaaaccacggtccgataataccgtcaacaattacatcatatccaccacgagcatatcgcttcgcagcttctaaaaacgcttcaatgacaatcaaattttgctcatttgattctggcaaatgcggtggtattgcccctttactcaaataatgataaaagtcatctgtgtgcatatgcacagacttttccaaatctgattcttttgcaacagcagatgccgttgtagtttttcctgtccccggcgcacctgtgattacaataattctaccttgattcatctatattttacctccacaaattacgattttcttaattctacaaacttgaattgagatttcatatattcaaagggatttaataactgttatattttattatcaaatatctctcaagcccttgaaaacactaagtttgtcgcaggtgagctttcccttattgtttcccttgtattatattgtcccatgagtttttacgaactctgataagggaaaaaacaagggaaagaaaatcttataaaatagtataacacaaaataaaagtgacatggggaactgattgaaatgcttctgatttttgcaacaaatgattgattgaacgataaggagatttgatacgatgagaacgatatttgcagaatacaatccacaacgcaacagcattgatgtttatacttctgctggctatatgctccgcattgactgctgggaagcggagaagaatttaacaactactcccggatctgactgtgcattaaacgcacttgccattgatgaaccacttgagtatgcaagattgtatcttgatggaacgatgcaaatgtggatagatgcggaagattccttttaggtatacgcaagaaacggcggctctgatttctcaaaaccgccgttaggataataacttaaaataggcgcgcaaaatcacctgccccagccagcgtttttttctttccccgtagtcggggcaggttcatgcgctatgcaattattcttctttagcttctatcaagccgatattttttgctctgcgttccacatagcagcatattttccgcctttcgcaagcaattcctcatgggttccagattcagcaatcctgccatcacccattacaaggatttgatctgcatttttgacgatggaaagggtatgagcaatcattaccacagtctttttctctttcagcagattggcgatggcctgctttactgccagttcgttctcgatgtcaagggacgctgttgcctcatccaaaagcaggattgggctgtttttcaggatagcgcgggcgattgaaattcgctgacgctcaccgccagagagaagatttccattctcgccagtcggcgtatcgtatcccttttccatcttacggatgaagctgtcacagttagcctcccggcaggcagcctcgatttccgtgtccgtagcattagggcgagcgtgtcggatattatcccggatggtatcgtcaaaaagaaatatgtcctggtctaccatagaaacttgctccagtacacgctctgcggcaacatggttaatgggtttaccgccaatagaaatcgtcccgcccgttgcttcataatattttgcaatcaggttcaaaatagtagatttgccggagccagagtctccgataatggccgtgagcttttgatctggcaccgtaaaggtggcgtgttttagtaccggttcaccgggaacatatgcaaaatctacattgtcaaatgtgatttcatgggtagctgtgtgaagcggctccatgctgccagtttcctccggctcattcattacactcaagattttgtttttcgagatcatcaggttcttataactggtgaggtctacaaaaatcgaattagccagctttgcacagaacaggggcagcatacaaatcaaaaggtagtccaccgtgttcagtgtccctgcgacccaaggtgcataggccagcaagataaccagcgggcaggacagccaactcaaaataccaaagaccgcaccaataggaagcacttttgattcgtacacaaagctgatccgacagaactcccgcatagcgttgataacggttttattcttcaaaccacctacgccataggcccggaaagtttgaataccagacacatactccacaatgctgctgacattctctgcacaaatatcattcttttctttaccatacttccgaaccatacggaaggaaagccacagtccagggatcaaaagcaagtcggcaatcagcaggataattccggcaggcacataaatggtcatcacaaaaataatcagcatgagcgaaagtgcaaaactctttgccatatcaccgatcttatgggtcaggattttttcatagttgtttacatcgcttgtgatggtattgatataatcgccggtctgtccctgggtaaaccgggaaagcgggatacgcttcaaatggtcgcccataaagaggcgggtattcttgctgacctctgcaccgccgatctgcgctttggtatagccatagctgtaaattaggatacgaagaagaaaaaccaccgcgatcatacaggtcagaaccaggacacggttcatgtcaaattgtcccgaccacaaaaactgcatgacagagtaaagcagcataaacaggctgccggagagaagcccttccagaacagtcccgccaacgccaatataaaaattacggttctttttcaatacatcatgctcactcatgctgctcgcctccctccaactgataagtaatattccgggctgtttcgtagtcctcccacgccttccgatagtaagcattgttctttcggacttcctcatgggttccgacacaggtaattgtgtgattttcaaccactgctacacgctcgcacatcttcaacgcgctcaaacgatgggctaccacaatgacagtctttcccttacagagattttgaatggctttgtcaatctccatctgattttccgggtcagaggcgcttgtggcctcgtctaagatcaaaatgggggcattcttcaggatagcgcgggcaatggcaatccgctgtttttcaccgccggagaagcgagagccgaagctgcccaccttcgtgtcatatccatccggcaaagacatgatgaaatcatcaatctgcgcctcttttgcggcggtccgtactttttccagagtggcgttactgcccatgcggatattttctaaaacgctgtcacgggtcaggaaggtcttttggaacacaatggcgacattttttaggatagtatcataattgagttcctttacatttttcccgccaatcagcacttcgccctcctgcacatcatagaaccgggagatcagctcaatcacggtacttttaccggcaccagactgtcccacaagggccatgcgttcaccatctttaattttgagattaacgccttgcagtacatcggtcttgccatcataggaaaaccgaacattccgaagttcaatatcgtgattttggggaaagtccgctccaccctcataaattggaatatccagtatctctttggtcttagtaacagcgttcagcacattggcaaaattagtccccagttcctgcagggggcgtatttccgtcagatacatggaacctacatagacgaacagcaaaaatgcgctggcagccagtgagcctttcaggaaaaacattccgccgattggaaccatcatcaacatcccacattcgatgataacaacaaaggccgcataaggtggccccatgcgccgggaagtttcattccacatggcgttttcttcctggatagcgtctgaaaacttttgaaacgatttgctccccatgttataggctttaatcaatttcatgccgctgatgtactcaatcataaccgagttcagtgtggtaatggagtgattggcccgttccatcaggtcatccgtattgcggaacatcatccccattacaacaacagcaaggatcagcggaaccagggaaatcaatgccagaggaatattgacggtcatcagataaataaagatgactaccggccccaccagatagcacacaaggtcaggaaggttatgggccagaaacagctccaacttttcaatatcttcattcagaaccgtttttatgtccccggtgcgccgttcattcaaggcccctaaaggcgctctggccatgtgttctgcaaccatgcagcgcactttgaaaagagcgccataggcccctttgtgggctgctacgccggaacagccaaacagggcaaaccgcaaagttaccgccactgcaatcattaccacggtatgtacaacaagttcctgcgtgcaggtatgattgaaggtggcgtccatcagccggtaaattccaatgtaagggacgataatgcaaagaccgctgaccgccgatagaaaaattgccaggaacagccagattttttgctcaccggcccagtggagcagcaaagctactctgttttcttttttctgtttcatagatcacctctcctttccatctgaaacagagaacagctctctcaatttcgggagggcatccattgtaactggtacatcatcgggcatttcgccctcgtcaaaatgcaggacacgggagcaggtacggcagacaaattcaaaatcgtgggtgacaatgaaaataacctttcccatattggacaaccggcggatcagtcccgccacctgcgtcatactgtcaaaatcaaggccgctggtcggttcatcgaataccagcagatctttcccacaaatcatgctaacagctacagctactcgttgcttttgaccgccagaaagcgtgtttggatggcgctcccgatattgggtaaggcctaattcctccaaagttgcatttaccagtgtttgatctggattgcgtataccaaaggagcactctgcctccacgctgtcagcgaaaagttcataattcacatcctgcataaccatgtaagagcgtttcagcctttccttacgctcaatcggctcgctttcccacaaaaattgtccatcgcagtctttgtgaagcccacagagagcgcgggaaaatgtagtctttccagctccgttgtggccgacaacaccaatcacttcgccctttccggcggatagctcaatgtcatgcaaaattgtttgcttcttgtaacggagcgtcacattccgcagctccaatacaggggtaggcgcaggcaagtgggctttttgcgggaataccgcctgtagatcaacagctcgcagccccatgtgttcacgatcaggttcagatagctgccaaaattcttccggggtgtatattcctttgatttctcctttttccagataaacaattcggtcagccaactccatcaggtagtacagacgatgttccgctatcaaaactgttttgccctgtttttttatcagccgcaaatgttcctttagttcctggatcgaagtcatatccagattagaggatggttcatccaatagataaatctgtgggttcatggcataaacagaagcaaaggcgattttctgcttttctccgccggacaactcaaaaatatttctgtttcgcagcttttgaatatgcaaatcttcagttgtctgctctactcgctcagccaatttctcaggagggcgagcttcattttcaattccaaaggcaatctcactgtctgtatcaacattgaaaaactgcgtccgtggattttggaaaacggagccaaccttagcggcaatctgatacatggggatattgctgatttcctgaccatctaccagcacacggccatgaagctccccctgataaaactgagggatcagtccattcaccagccttgtaatcgttgtttttccgcacccgctgcggccacagaacaggacgaattctccgtccgaaattttcaaattgatgtcgcgcagcccaccatgttcctgccccgtataggaaaacgatacattttcaaactcaatcaaccgatcacacctcctcgcacacataattcaaaaatcagataagctacggcaaaggccatgacgccccaatcggaaattccgcattttatctggacaagacaggtgcgtggattgggattttcaattccacgagtgacagaagcaacagaaagatcatccgccgcttttgaagctgccatcaataaaggcacataaatacactcaaccgtcatgcccggatgtgttaaaaagcccgccagagatggtgaaacatctctcattcgcatagcgtctgtgatatagcgccagtcctcttgaatagttggaatgtaccgcagcataactgccataggaattactaactttttgggtgcgcggacacggttcatagcagacaggaactcattgacttttgtagtagtcagaacaatcccagccaaggttccgcacgcatagaccttatgaaacaagcctaaaaaggcaataaacattgtccgcagcgtgcctgtcatttctgccatgatccaaactgtcagggcacagatgaccgcataaaagcatacagccttaatgacatatttccactttccaaagaaagcccccaatatcgcaatcagcataacaaggataaattgatatgcaagtgagggcgcaaacatggacgataaaacacacataagaataagaaagagcttggcccgtgggtcgagccaaagctctttcttatggcgtttaccgctcatgctgtaatacctgctttttcaaactgctttttcagcattttgcagcctacaaaagcgctgattgcagatgtaatgataacagcagcaaacatggcaatcaggatgccggtatttgcagttgcctgcatggtgtcgatgtaactctgttcagttccgttccccagcatggtctgcgcccagccgttggggtcaacaaagaacacgatatatgaaccagtgccaccgagagagaacaggatataagacaggctgttgagttttttgcttttgtactgccctgcaccagcaacaaagtccgcgacaatcgccatgatcatgtagcccaatgcaaaagcccagtgcataccagtcacgaaccaaataatacccatgataacgcccattatagaaagactccaacgcttatgtacttttgcaatcagcaaaagataaatggggccagcaagcagcccacctcctgctggcatgaaaaaagtaagtacaggattcgttgcaaaaaagacaccgcccaccaatacaaaaacaaataacagtgcagtaaaaatacctgttgttacaaggtctttcactgtcagacctttgttcatagaatttacttgattactcattttgacctcctacctttcattgccttgactcgacaagtggtttgtgatattcttcggttagatacctctaatcttcgtctaatacaatacgcatttatcgaacaacattcaataggttccggcaatgttcgtctgttcctttcaaaagttcgtctaatcgttgcaaaaaggaggcggtctgttttcatgtctgaaattattgaccagttttatacaccgctactaattgaacacggttttatccgtgacccagacaaccagcaatatggggcattaggtgactgctggaaactttctcccgaagttggagaaggcacctactggacttatggacagaaagacttatatgatattaaaatccataacttttccttccacgaagatttcatgttggaatgctctatgccggaatgtctgagtatcactcggtatgactctatttccggggaggaattatctccataccgtagactgtctgccggttgtatcaaaacatttattggaggctacactccatacaaggctttgatacataaaaatattccaatccgttcggttgggattgagattgcaccggcatattatgaggactacctgaaaaaactgtacccggaggcacagatcaatcctgtggatgcatttcggaagatcgaccaaacatccgactttccagaaatgtcacggttactcactgaaatcaaagactatcgcggggaagggattgcagcaaaacttttttatgagggtaaagtcgcagaagctgtttcaatggtggtggaatatcagaagaaacatcctaataaaccagcccataagctctctcaacaggatattgaaaatctccaaatagttgccgcttatcttagcgatcactatgcttttgatattcctctggaacggctaacacagattgcctgcatgggaacaacaaagctcaaaagctgttttaagaaatactacgactgcaccatcacggaatatgttcaacagcggcgcatgagtcaagcagaatatctgctggcatatacagaactgacagtcgggcaagttgcccaaacagtaggctattccacttcaagccgatttgcagaattattccgtaaaagcactggattgttgccactggagtacagaaaaaacgcacagcgaaaataaaatgagtgccagaggaaactctggcgcttgtaaaatttttcacccacattctagtcgggcttagccatgtgttgtggaatatatacggaatgcatcgtcaatattccactgctgcttgcggttgttaccaagatagtgagagctcatctgaacacaaagttaccattgccctttttcgtacctaaacgaagtaagatttcatgtacatgctcatcactgaatttttagaataatctgtcctagcacgaaagtaaatatgaatagtttctaatagttttttaataatatcctcttgcttcccgccatccctttacataccacctgattccaacatataccagttgcacgaataataagagaaatagcagattgattggcaatgctgtctttatccaattcccaaagtagatagctgttgccatgcttataagtattaccattatggtaatcatgtcccaacagtatttcttatatagccctgcaatctttatccctataaacgctacaagtattcccgcacccaccagacatccaccgcaaatcaatattcttatcagccagtatataattccggcaatgactggattggatattccattactaatctgtgccacattctttcctatcagtgcaatccagccagcaatagtctgtgtgaaagttccgattgcatcaaagaatattctgcaatcagaaataaatacctttgactgtatcatctgaaaaagagtagttgatgcggaataccatatcagcagaaacatcaatgcttcatacatgactgtttttgttttatatctgcctgccagtttttccctctgcgtatcatacttttctttggctttcagataagctgtctgattacaattctgacacttttgatagagtaccggcttttcaaccggtatctctacttttttctgatgagagagtgcatagtcccgttcctgttctgcctgccttagcttatcttgacattcctctgtcatgatttcggcagcgtgcgttttctctttctcgctctgcaacaattcttttgttttcctcaagtcgttctttaaggcttgaatgttccctgctctgttctcgctgtttaacctctcgttcaaggtcagcgattcgtcgagctgcattttcagttcccgaatagtccggtctttctggtcgagttcttcctgcatctgctctgtcagcagaagcaactcttccagttgatcgtcgctctttgagtttcttaattcgttcatcaatcaaccttcctttctctaattgctgttcaagttcagtaattcgctgttctgtttctgcaatagccggttctcgctgtttaatttctgtgccaatttctgccattgctgattttcgtctgtgagtttctgtatctggtctgtcttttcttccagaagcatcaacagttcttctgtatccggcaagatttgaagcagctctaataattcgctctctaattgctgcaatcgttcttcctgctcctgaaaacacatcagcttctcgtccttttcctgtatctcctgaagcatctctgccatgatattctgctgttcctctatctgtgtaatcattgcttccatcatgggaattacttctttgctttcttctaatgtcattcaaacactccctccacatagacaatgcaccggataccttaccaaaggttgcaattaccttttgcagcagtgcattttgttttttaatcatctggttttcctcaaccttccatgaacctttccttatctgtccggtgagatatttttcctcaatcttccttgcatctgcaccctcatgaatcgtagggactttcaatttgccctgtctttcataagagcggtggtcaatctgattgtctatggataaatgccggttacacatcctagcccattcgcttcgccataactcacaattttttggactgttccagccggtagcatcggtcagaacccgtttccattgttttctgtttcttgccccgactttctgtactccgttttcatcaagtaccggaatacggattccatgacggtctggatttttcttatcctgccaccaatccgggtgggattcatcaaccacgatattttcctcagtatctctgacaaaatcccagtccttgacttctttgttgccccatgaatgatccggattgaatggtcgcatggttacaagtaaatggacatgtgggtttccatcgttcttatcgtgtatgctccaatcggcacacattcccttgtccacgaaagttttttgaatatattcggttgtataatcaatctgttcctgtctgctccattctttcggtaaggaaaattcaaacgagcgtccaagctgtgcatctgcatttttttctatcttcaatacctcattccatagccgctgtttctgaaatgtgattttaaacttttccagtgcagcttccttatcgcctgcccttttataacggatagactgttgaaacctttttatattttcttccggtacatgcagccattcaggaggtgcattttcacacatcatcagactggtgtagacgacttcctttttggaagtgtagtagctgatcctgcctgtttcctcatttttcatcacatctccattaagatatgccgatgcggatatgacagattttcctttactgcgtccgacaatctttactgtaaagtgaaatatcgccatgatacgattccccctttctgccgtatccggcattgatttccgacagcatcttcttctagtttggcaggagtgaagctgtcggaacgccctctgcgcaagagtgccccctgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaacccactccctccgccattacacttcctccatgtctgtaactaattctttctgcatcgcttttgagaaaaacttcccgtttgtttcctgcctttttaagaagcctatcaactttggtaaatcttcctcctcaatcggacagccaagaactgattccaccgctcctccaatctgacagagcctgtgggttcgttttttactttcttccgctttctttctcttttccagttccttccgctgtgctatgagcttttttgtagcttcaatgctttcctgttcctttttctctaatgcacgtattctttcttcataagtctttgttgatttcgccatatcgtcttcatcctttctttttccgataaacaacagttcccggttgcatatcaggagaagcacatggtataatcctcttgcgtgtaggtatatcatggcttcggtctgatagaacctttggcggtttcgtaagaagccgcctttttaagttgccacatttcttgtgacagcttttacatttcctttatccctcagatctcgtccctcgttggcttccatgaacttttccagaatgtcagttttaataaggacttttcttccaacctttaataccggaagtttcttccattcaaccagttttctcaaagtgtttctgccaatccctgtatagtcggctgcttcctcgatggataatgcaatctttctttccgtcatctcgtcacctccttgcaaattgcattatgcaatttctattgtgctgttagtatagcggttttatattgcgttgtcaagcgttatgaaattttaaaaataatcattaaattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggacgattacgaaagcaagaaattcattgcaaagtcggaaaatattacaattggagaattacttgatatatgggcagaggaagaattaaagaccggtacgctcagtaatgggacagtccagaattacctcggtgccattaccaacatcaagaagcatccaatttcagagagaaagttgaaaaatgtaacatctgagcatttacaagccttcttcaatctgctttcctttggtggcacttatccagatggttcagaaagaaaaggttatagcaaagattacattcgttctttctcggcagtattacagcagtcattccgatttgcagtatcaccaaagcaatatatcactttcaatccgatgcagtatattaagctgaaataccagacggatgaggttgacctgttttccgatgatgacatggatggcgatatacagccaattccacgagaggattatgaaagactgattgaatttctacagaattacaatccaccggcaatacttccaatccagatagcttattatgcaggacttcgtatcggtgaagcctgtggtctggcatggcaggacgtgaatcttgaagaacagtgccttacaatcagacgcagtatccgatatgatggttcaaggcacaagaatatcatcggaccaaccaaacgaaaaaaggtaaggattgttgattttggagatacactggcagagattcttcgcaatgcccgaaaggaacaacttaaaaaccgaatgcagtacggagaactttaccataaaaactactacagagaagtaaaagacaaaaacagagtttactatgagttctatcatctggacggaacagagaatgttccagaagattataaggaaatatcctttgtctgcttaagaccggatggaagtttggaactgccaagcacgttaggaactatttgtaggaagattgctcagaaactggatggatttgaaggatttcattttcaccagctgcgacacacctatacaagcaaccttctggcaaacggagcagcaccaaaggatgtgcaggaactgttaggacactcagatgtcagtaccacaatgaatgtctacgcccactccacgagaaaagccaaacgggaatccgcaaagttacttgataaagtggtaggcaacgactaaataaaactttcccttatttcccttacgattatctcataagggcaaaaataagggaaaatacatatcatttcactaatgaataggctaaaaagcctgtaaaatagggaaagttataaaaatatttcggcaaactggaatttgagtctctgtaaagctggaattaacccatacaattattttaatttagaggttcttacgcaattatccgtattttgtaatttttcaatactggaatgccagtgtaaatcagcattctccatttttattaaagcgaaaaacgtaaaattgcggaagaaccaatttagatattcacaattttacttgccacagtatctcgaaaaacactgtcatgttctaccaggagcatggtcggggcaaactccgttatgagttgttcaatctgcatacgtgagtacacatcaataaagttgagcggttcatcccatacatacaagtgtgccttttcacaaaggcttttcgcaattaggactttcttcttttgcccgccagaaaagtctttaatatccttttcaaactgtacacgctcaaagtccattttcctaagaattgccttgaacaaactttcatcaaggttgttttcttctgcaaactcggaaagggttccacataaatacgatgtatcctgtggcacataagaaattacaagcccagagccaagtgttactgtacccgtataatctatggactgcccgactaccaactttaacaggctacttttgccactgccgttctttccatcaagcacaatgcgttctccctgtcttatttcaaacgaaacgggttcacaaactgaaatgccatcataataaactactacattcgataatgatgcaagcaaatctgtatggtaattaagcggttgtatcttgagggcttctgcggtttccatatttttcagcaatgctgatttttgttcgattgtctgttgttgtctcgcttctatagattttgaacgcttcatcattttggcggctttatgaccgacataacctttatctgctgccccaattttggaagcttctacacgttcagaccatactgcagcgcgttttgccgactgctgtaatcgtctgatgtccttttgcaaacgttcgttctgagccagttcaaattcttgctgtcgctcaaaatttgacatccatgatgaaaagtttcctctttgcacttcgatattcgctcggttaatcgatagaatatagtcaacacaatcgtcaagaaagcgacgatcgtgagaaactaagatgaatccctttttctttttcagatatgccgccacactttttctcgctttggcatccaaatggttggtaggttcatcaatcagtaggaaatgcccttcattaagaaaaagagcggcaatcaaaacctttgtctgctctccgttggaaagtgtttcaaaaggtcgccaaagcacatcgacatcaacatcaagataagaaagttctcgcataagttcccattcttccgcaagtgggcaaatctcctgcaatatatcctctgtaatacgattcttatctgaaacgggataaggaaaataatcaaactgtacggatgataggatttttccactatactcatatttcccaagcagaagattcagaaaggttgttttacctcgtccgtttctgcccacaaaaccaagcttccaatcggtatcaacctggaaactgacattttcaaaaacattatcataacttgtcggatatgaaaacgtaaggttttcaattttaatcattgacataaatattatcctcctttgcatgtcatacgatacaaagtcggttcggtgaatgtttactacgtatagatttcaccaaaaggaaccgacactatacggagtgaatcatgtgtaactatctgttctgcactattcataaagcacctccaaaacaaaataagagccacaagaaagtttatccttgcagctcgtcatagcataaaataacaccactaagcaaaagtggcaacagcactatattgagtaagatagacatataactttcttgcaatagacacaataatgccaaagtatagcactaccgcatattttgattttatttgcaagaaaagttaatcatcttcccacctctttctaaatttcaaaatattataccataaatcgcaggcaaatacaagtggttataaaaatttaacaaatcgcttataatacaatcatataactttacgcattccttactgaccgtaaaattccgatttattgctgactttattatactttattgcctatcgaaaagatagcatattttatgaaacttgtcggctgggaacagcttgcaacgcaaggtgtccccagatgacaagtccacaaaagggtagctggcggtagccagcgcaggggaagcgtagcgtcccctgtatgatttggagcagaccatgactgcgaaaaatcacagccctccggcaaggagccttcggagaacgcaatgcaccaacctttgggtggtgtataattgcgcccttagtaaactaaggggtttccggcttctcacgttccagcagtttcttcaatagttcctgcgtgtcctgcctgtgaaaaatgagtgtcaacaacagcatgacatcatcatctgtcaggcgttccggctcttgcagaaaactttccagcataccgccacgagtacagagccggtgtgtccgttcttttcgggtaagctgctttagctggtgctgcaatgccttttcatcattgatggctttccgcagtttcttttcactcttttccaactctcggttgagcttttccagctttgaggtatcaggcaagggcagcgtcctcctttcccggtatcagcacataaatcctgtttggttctccaacgccctgacgcactcgcatgatcagtccggcggtttccagttcattcagagaacgcttgaccgtcatggggctgcgggacaggactgcggcaatggctgtgacagggaagcagataaacaggattccgttctcgtcctcctgtccgttggatagcatagcgtccaacatccggcagtacatgacctttgcggtgctgctgactggaaatcctgtcaacgctctgggaaagggcatacagggcggcaacggtgtgcctatcgtcataaattcaaaattcattcggtgtgttcctcctttttctttgctcttttggataaataacgggggcagtcaaccacaaccgcccggaagctctgcttgcacccatgcttgcatttccggcataattcgttgtaagtgacacgcccccggtcattgaggtaaaaagaaagctcatgcttcctctttttgctcattctcggcatattgcgtttcctcccgttttagtgtatagtttcggggcgattttcggcaaaattacggtcatagagccgtctaaaatctccagaagtatcagcaatagggtagactatccccctatcagattgtcgtgtttcggtatcatttcggtatcagttcgccagttctccccggtgtcgttcctcccctgaatctcacagcggcgtattgctccctttggtacgctcgtttcggtcagggttcctccatatccctgccaaaagtcatggcgctacatcgccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgtcagaagggggaactgcttcaatgaacggagctactacaatacaggaacggctaaaagatttacgattaaacaaaggattaaaactggaagaactggctgaacaaacgggtatttcaaaatcggctcttggcagttatgaaaaagatgactataaggaaatcaatcatggcaaccttatcctgctggcagatttttatggggtgtcccttgattatctcttttgccggacagagaaccgggcagagatcaacacgccattaagggagctgcatttgagtgatgagatggtagcacttctgaaaagcggtcggattaacaaccgtctgctctgtgagcttgccacccataaggactttatcaagtttcttgcggacattgagatttatgtggatgggattgccaccatgcagattcaaaacctcaacgcccttgtcgataccgtccggcatgaaatcattgaacggtatcgccccggcgaagatgacccgcatttgaaggtgctgcaagctgcccatatcagtgatgatgaatatttcagtcacatggtacgggatgacctcaatctcattatccgggatattcgggaagctcacaaaaaggacagtgaaagtgcgccccagaccaccgttgccgatgaactgaaagaaaatctggaagcggtcgaaaatttcaagggcagccgggatgaaaagctcgttgtactttactgcaaacagctcggcatcaactataaaaatctgtcagacgaagaatttcgctggctgattcggattctcaaaaaatcaaagaaaatgggaacgcctatcagccagaggaaaaaacggtaaaaaaaaccgctgttgcatggttggggtgccttccatgtagcagcggttcttgctgtggttattatttcattcgttttcttaatatccggcgataatttgtttctccctttggtgcgtcctgtataatttccaacacaccatcttcaagcattttatcaatgcgattagaaatccatacatcactaattccaagttgatattttcctaaaacattacctataacaatagccattttgaattgctctggctgttccgcaatttcacgaagaatgaaactatcatatatatcttctgaaacactttgcaatttaccatttagcattgcacgcaaaggtgcattttcattttgaagttgattccatttcatagcacaagctgaaagaaatacaggcttagctttttcttgtagagttatatattttccccattcgccaggagaaacctcaccccatgctattttggatgtcatagtattttcttttccatattcccaggcaggtaacttaaccaaataaattgttgtctgacagtttaatggtcgaagttgtttcataagccagtacataccgcaaagttcatccggattatagctataccaaatacgaacttcttccccagctacatatcgttcaataaccgaagacaatgtagttttaattttctgtattttttcttcaacctgatagtctaaatcctctacaaaccagacagacagcattttcttgagaacatttttccgctgttcgccaattccattatcagaaatatctcccacactaagagccatatcaaaacaataaacatcactgctcttgcctcccaatggaatagcattctcccaagcaatatgttcttgttcctgtgcttgaatttgtgcttctttcatttcatctgaagatggaacactcccatcttcgtgcctcataaagaccgaaactgcacttcctctatactttcccttaccgtaagtttgggcaattttcaaacttccacaggcactttcaccaaatacaatttcaatcatcttatatacctccgatttaattactcccgtatgaataaattatatcatgcaaaacaatttcttctgcccggttgtgaatgttattacaacgctgcacccattccatttgttgagttcgcttcaattcctctgtcacgccctcggtggctttcatctgctccatgatagtgtctaaccgttcctgtgcctgttcgttcaggtctgcaagatatgtccacaattctccggtcagtatcaatgtattcaatctggctgggtggacttcccttaaatattcccggtgcatccgtccgtactttccgatagggcggtgttcctccggcagtttcaagtccgggatgtagtaatctccgacaaggatataatcaattccgttttccgttattcttggtttcaattctctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcagcaagccttaaatcctctttcctcatatcacgctctaacagtgtgtgccagagtggtttatagctgatgtgcatattgttttcctgcctttctatccataccaccggggcggctgccccggcaggaacttttctcttattatagcaccaatcttgtgaaatcacaatttattcttgtatcctgccgctgataccgtctggattggttttcctttcttttttgttccctttaattagccatgaactgcttcatgccctgagattttactgatgtgtgataaagaagtaatagaagtgtaaagaattttgccgttcctatccggcacatgaggtatgtcggataggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccgaacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaaaatagcggataactcggctatgcgtttctcggtggcttccagctcctttttcttggcggcgttcctgcgcttgcccccgtcctcgttctgctcaatcaagagcttcataaaccgggcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactaccgcagtccgcacagaacagtatgccggagaacaagcccacttcatcatagcggtttgggcgtttgcgctgtttgcgaagctcctgcacccgttcccatgtttgggtgtctatgataggctcgtggtggttctcgaaaatcacttgcttttccgggggattttctacactgtgcttgactttgtaagaaagtttttctgtcttgaaatttaccagacagcctgtgtattcccggttttcaaggatatgcactacggtattggtcgcccacttgcactcatagccggggtggtagcggcgggtgctgcccgtcctgcggtattcaagcgttcccggcgtggggatttgctgctctgtgagcatacgggctatcttggtcggaccattcccggcaagacagaggttgtatatctgcttgactacgggtgcagcttcctcgtcaatgatgaaattttcgtcctcgtccatgaggtagccatacacaggcttgcttgtgatgggcttgccactcatgccttttgagcgttttaccgcccgtattttcttgctcgtatctctcaccagccattcgttaaagatattccgcagcggggcaaagtcattgtcgccctgtgcgctgtccactccgtcattgatagcgatgaagcggacgcctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgcttcgcataggtttcaaggatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggtggctgtctgtatagcggcaaaagcgtcaaatctgcttctttatggtcggtcaaatcgccattttttgtgtagcagcttccgcttccagcactttcatcatcttgtcggctgcggtatcggttgcgccctgcttgaagaagccggaaacggtaaggacggagttgcccatgcggatttccgtcacacagtccgggcggcggtctgttttggtggtgcttgtctgtttcgtttctgtcataggctctcctttcgctgcttcatcagttgctttaagcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctgtaaacctgttccagcccgtactctgtccctcgctccataccgaaatcatcaagtatcagtagaggatagctgcaaaggctggaaatatattcgttcctgccctcaaagctggcggcaaggtcacccagtatcgttgcaaagtttgtcatgcagacggcaacttctttctccataagggcgttggcgatacaggcagcgaggtagctttttcctgtccccacgccgccccaaaacaggtagccgatattttcagcctgcatggtttcccagctctccacataaaagcgggcggtttcggtctgtgggtttctgccgttgtcatgctcaaatgtccagttttgcatagcggggtcggtaaagccccggcgtttcaagtcctccactttttcaaggtgcttctgtcggctttcagcggcttcccgtttttcacgggctgcccggtggcagtcgcactctgccgggtgtcggtcatgccctaaccattgggcggtttcttttgaaaaataggcttctttgggcgtatggcacttgccgcagtataaaagcccgtcctcgcctgtgtagtcctccgcttcggcggtagtggctgtaatgtccgtaatcatagcttcaatctcgtttttcataagctctcgccctccttgcatgaataatcgggtatgccctgtttcggggcagccttgcctttggcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgccccgtttttccctctctctctttttctatctctatctctttctctaactctatctctatctctggtggacgaatgtcggacaaatgtccgccttttgtccggggcggtaaaagtgccttgttttccagccttgcagcccgttttcgctcggcttcggtagaggactgtcctatcatcagctcaatgtcggtcatatagaaagccccgctgtcaagctgctccacaagccccaactgccggaaaatctctaaagccctctcaactgtccctatctggtggcgggtcagtgtcgctatcatctgtgctgtgtaggggatatgctcgtcaagctgcaatttcccgccgtttttcagcgattttaagtacagcttcaagaggatattggaatataaaatcccgtctttcatatcttccagcagcacaatggagtcgctgtcaaaaagttctctttcagcttgaggtagtaatacttgcggttatctgccattgtccctgtcctcctttttccggcgtttggagtagtagcgggggcagagtatgataaccgcccggaagctctgcttgcagctatgggtacagccccggcagaggtcgttgtatgtgatacggtcgcaggtggtattcccgacttttacttgccgcaggaaaaaagaccattccagccgccgtttcttgctcattcttggcatgggtgcgctcctttctgccgtttccgctggtgtggcggtatcggcgataattctgtatcatctcggtatcattttcgggatttttctgccctgtaagcccgttaaaaaatcctttggtattgccggatagggtacggggcagcccccttgttcggtatgggttcgggtacattttggggtggtttttatcgctcctgttcctgccttttcacaggcttgcgttcccggcgtaaaatctggtcgatattgcccttgacagtctgtaagcggcggtattcctcccgttttgcccggtaatcgttgtagccgctgtttttctctttgataaggctttcaatctctgcttgcagggctttatggctcggcagcttggaaatgccgttctccctgaaatagcgggcggctgcgtctgctatgataaagtcgctttcgtgcttctgtcggtaggctgcttttgctttggcgtttttctgctgtttcagcccgtcccggacagggcgggtcttggaataggcaagcacctgccgttgcagctcctttttcccgtccagcgtcttttccacctgcttcagctccgtaaggctttctcgcatggcggtataggcggcagaacaggcttcgtccagttcctccggggaagaaaagccgtactgctggtaggcggtaacggtagccgccatttgctttagattgtgctttgccgcccagcggtcatagcccacgcccttgccctcggctcgcttggcttcccggtcaaccatgcgctgcaaggtgttgtctgccggggtggtttttgtggttttttccccttgtgacggctttttaactgcgacagggtattcgggtatggctttggtctgttctgcggctctgcgggcgttctgtgtaagcagggcaaggacagcagccttgtcaaaatcgtcccccagcttccgggctgtgataggctttgtcctgtccggcgtgaggtaggaaagccgcccccggctctccttgacggtcacaccctcccgcagcaaaagggaagaaaactcgtcaaagctaccagcttgggaaagtgcctgccgtatcgtccggcgcagcttcgccttgtccgtttcaaacttggtgggcttggttggctgtccggtggcttctctggcggcgttctctttatcaagggcaagctgccctttctttgccgcccagtattcccgttccgttatccgttccttgctgccgcttaggaggtcgatttggtaaagcccctcccggtggcacatctccatgacttcactcttgaaatattccatagcggcgttggtgcagcggtgcttgcagccctcccgtgtatcggctggtctgtccatgtagggcagaagcgggacttcataaatccgcagggagttgatgacgatatgcacatggatattgccgctgtggttatgcccgtccgggtgggtgcagattagggcttggtgtccggggaaatgtgccttgcagaactgctcgcccaactcctgcgcccggtctacggtcaagccgttgtctgtcccgtcccgtgggtcaaagcttatgatatagtggtggcttttcacatcttcccgtttttggtttttctcatagcggagattagcccgcatacaggcaacagcgaaatcctcgcccccgcagttaagggaagaaatgcggtaatcctccctcggtatcagccgcccgttttcatcaagggtgggcttcatggtaaactcgtcatgctcaaatgtgaggtaggcttccgctgcgccatagtctgcatttttagagctgatatgtttgaatgttgccaaccgcgtcacccactttctgcaagatttcaaactttagggcagcaaggtcggaaaccgccgcccgtacctccccggcaagctgcgggtaggggctgtgccactcgttcagcgtccgggctatctggtttaagttgccgccgatcctgccgtattcggcggtcagcttcccaacagcggcaagcagctcgtcattgacgggggaaacagttatgatggggcgtatggctgccccggttatggcttgccggataaactcggattggctcatgttgcaggcagaaagcctttccgcaaactcggcatattcttcctcggtcatgcgtgtcttgactacccggctgcggtgcggtgtgttgtatcgttttcgcatggtaaaacctcctttcgactgccgcatggctgcggcgggataagcggcgtaagccgcatggcagggtttggggaaggcactccccaacaagattcccgcaggggcaaaatgagcgataagcgaattttggtactgcggtagaatcttgctctccgtgactgcaaactttctctcacttccgtccgccacttttttggaaaactgcaaccacaaaagtttgtttctctttttctgctactactaatcctgtaaagggcattcctgcccgctttcgctaaaatgacaccggacgcagtggtttctacccggtgttggagaaatcctttctctttgccctctactacgggtaaatgctccaaatgccaaacaccagggcagaaaaattccctcctcgcttactactacaaccggcagggggcaaaatggccgggagcggagccggacaacaaaaaaagcagtaaatctttttcaagacttactgctttcgctggccgcgtcggtggcggctggtattcagtttttatgacttgtccggtggttcgtcaagccggaacttgaattgacagtcaattaaccgctgctttacatagtcctccacctcggcgttgacctgcccgttcacttttgagaaatagcggatatatccggcgtagtggagcaggacagcgttcacggcttctgggtcgccctcacgggctttgaggattgtttcataggggagaagtctactcataccggctcacccccatttcttcgcgtagccgctgcaaggcaagctggatatgccgccccgctgtgctgcgtgaccggccaatacacgcgccgatcacgcgctgcggctggcgcagaaagtaatagcgcaggatttcttcccgcgtctgctccggcaaaacagagatcgcgtcggcaagggcggcgttgcagagcaggacggtctgaccgcagacggtaaatgggtattcctcgtccggctccggcgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatctggtcggtcatggaaattcccctttctgaataatagtgcggggcggtggcacttcttgctgtcgccccttgattgcctaccagcaaaggcgggcggggctgtcaacgacggcgcatatgcgccgttcatcttgaccgttgactggctcggctgggtttgctatttacccgacaaacttgaatttattttaagctatcacgttttaccttcttaagccttactatcattaccataggaatttctttgttggttttaaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaaccgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcctgatatcctttcagctctgtaaggcatacgctccgcccgttggtgtaaaaggccagatcagtacggtatgcctgtatacagcgggcgggaatctcgccagtaaagacaacttcatccttttttacctgggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgcccccctgttccccaatcggttggaacagccctgtcaccgcatccatcaacggttgaatgccaaggccatttttggcgctgccatgatagactgggaacagggaggcgtcttgaacccgctgctgttcctcccgcgcaagttttttccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggcaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccagccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattggcgccagggttgtcgttgccgtaaccttccaacaggttgatgacaccccagataccaagaccagcgcccagagcgataacgagagtctgaagaacggtaattgcctgttcaaaaaatgccataaataatattagccggaatcatttgaatgattagttaggtttgtttcataagcgcacaaaagccggaacaatctgccctcgatatatgagagcctgattccggctgtcctcctttttcattattttgttgatgattgcccgctttgtacgccaatggcctcaacagaggcagttgcggcaaatagatacgatcactcctttctcagcggaaccgtattacacgccctccgtgtctacttcatatacatcgcagacctcatcaggcttgagttttagtctggcagacaaaaatgcttcaatatcaaaggtatttcgcttgtctgcatcagctgtgtatttgaaattagggtgtctggtaatgtcatacttgtctgaaagaaacggacgcacaccgcgcaactgcaagatgcacttgccgccatccataactgccagctcgtcctggctcatcagctcttttcccaatttctgataattgagcgagtgggaggtctcccgtccccggctctctccggtgttgtaagtgtctatggtttcctttcccagaacagccgccagctctttcagcgttgttggctctttgccacccaggaagatggaagtatccatattgccgatgatggtatcggcattatctttgtaaattgccttgagctggctctgtgcctgcaacaccagacaggcagagatttcacggcttcggatggtggccaccagcttttccagcttcggaatctgcccgatgttagcacactcatcaatcaaacagcgcacatgaaccggaagcctgccgccatacacatcatcggccttttcacaaagcaggttgaataactgggtgtagcacatggaaatgagaaagttaaaactgtcatccgtatcactcataatgaggaacagagccgtttttctgtctcccagcgtatccagttccaactcatcgtaggatgtaacctcgcgcagctccgcaatatcaaatacggccagacgcgcaccgcaggaaatcaaaatcgacttagcggtttttccagagacgaaaagtcaaggactttttcatcaaattcacaaagaagtcacattttgcggacttcctcacggagcatacgcttgattttgtcctccatcgtctccttggcggtctcgctgaaatggacacggacgatataggttgtcttgccaatctgctttctgacagtagggcaagtggtgctgttggttgcggtattgttcattcaaaatcctcctgtaaatgaaaaatgcccggtgactgttcatcatcgggcggtgtcggtatgagggaacaaggcaaggcggcaacattaaggtatctataaaaaccttgccgtctttgccatgcttgccgtgttcctgcgtcagcttcggagatagcagacccatgctgtgccgtctttctcggtcacaagcctgtctccaatacggcttttagctgtcctcatcgtgcgtgaggatatgcccctgtcattgaccgctttttccagctctgcactcggcattttctttccgtctgccagcagttccagtatcagcatttctgcctgtgcggtcttactttccgtcttggcggtgtctgtcccggtaagaagctcgtcagcggtaatgtcataagcccctatccactcaaagcctttctcgtctcccagagaaaatgcaagggactgtccgggcggcgcaagggagcttttctcatggataagcaccctcgttgtagggctgtccttcagcttgccgataaaaagcagactgcggactgccgccgtaatgtcgatagaccccaatccccggtaggtgctttgcgttcctgcggctttgttcaggtgtccaatcagcacgatagcgcacccggtagcctgtgcaatgtctcccagactgcggaatatcgggcgcacctcgtttgctctgttcatgtccacatctgcgcccagaaacgcctgtaccgggtcaatgataaccagccttgcgttgttttcccggattgcccttgctatgcgctcatcggcaagggtcagcggtgtgtccctatcgtcaatgacaagcactctttcaaggtctgcttccgctttcatcagtcggggcttgacggtatcgcccagaccgtcctctgcggtctggtagatgatgttgaaaggctcaagggtctccataccgggtaaaggctttcggttggtgcaagccgccgcaagacgcatggcaaagtaggtcttgccctcgccggggttgccctgtataatcgtcagctttccaaaggggatatagggaaaccatagccaatccacgctcgtcagctccacatctgccatgcggagcatgggaacaggctgggcggtgggcagctctcgcagcgtgattgtctcggctatgaatttgcggctgggaatgtccccttgctgacggagaacatcgttccagtctttccttgccgggacaaggcgaatgacggcgatctcgccgggaatgtcctgtgccagccgggtgcaggcttcacttcctgcggtgtcgctgtcaaggcagaggaacacttttcgggtgtccttgcgttcagaaagaaaacggtcaagggctttgcctgaaacgccgcccagggcaaggtagctccttgcctgccagtcctgcggataaaggcagataaaggacaaaaggtcaatcggtgcttcaaagacaaagagctggttgccgtttccctcatagtggaacggataggatttgtcagacccggcaatgtcctgtctgaatgggtctgccgttcctcgcacatgggcgtatctcggcgtaccgcttcggtctctgccgacaaacacaacattgtgccgctttgcgtcctcgtaaatatccccggaaagaagaaaagcctcaacaagcgttttgttgagacctcggctttcgcaaagatattgaattgctctgtcggctgttctgttgtgcaagggcaagtgaaacgctgtgggcggtgctgtgctggcttcgctctgtccctcggcgctttcgccggttaagagctggactgcttcgggaaaggacttgccgtaaaactccatgacaaaatcaatgggatagccgcccttgctctggctgtggcgaaaccatttgtttccccggacggtcaggctgtcatgttctttccagcggtattcccgtccgcttttgataagtgtctctccctgtgtgcggagaaaatcttccagactgacggcgttcgcccggtcaatctgtgcttgggtgtaattcatcgggatagttcctcctttttgtgtcgtgtttggggtcgattttggtgcatttgttcctctgtacgctcgttaaatcgggcggcagtatctacacatgacttgaccttccaaagacggtgtaaatcgtctctgacggtcttaaactcgccataggtggtttcgtgcgcctgttccagctcgtcatactcttcggtcagctttttcatatccaccttgccgtccgggaactctccggtcagcttgcgtctggcggcgtagaactgtttcagtttcgcttcatgctctgccttgtacttggctctgggcttctcaaacttgattttctgcaagccgtcatagacaggcttcaagctctggaaagcagcggagctgtcatagagctgcttaattgctttcattcgggcggtctgttcgtccagcgttttcttcaagctctctgtggcagcactgtgttcgctgacacggtgttccaaatcttcaagggagtaaatgccgtttgcccggagataattgaaagtctcgttcatctcctttaggttgctgaccttgcctttctgcgaatatgccccggctctgcgctgggtgtaataggcgttcagcagagaaacaaggtcgggtgcctgcggcttggcaagctccgcttttgcttcggcaatccaatcaaacaggagagcgattttcttcttgatgtcccggataacggcattggttgctctgatccagcggttgaactcgcctttctcggtgcgtatgcctttcttctccattgcccggacggttgcgccctcatggacggtgggaagaagctctacgccctgacgctcatagcttcggtggtcgatacgaacgtcaagccccttttccgcaaacttggcgttgcataactctgcccatgtctgccgccagtattccagcgtttcgggactgccccagtcggtagtgggaacggcgttgaaaacaaactcgccgttctggtcccggatacggttgccgtcctcgtccagctcatacacccggcgttgctttagcccccatttgccgttctgctcgatggggcggatagggcaaagcacatgaaaatgtggatttggtatgccaccgtcctcccggtctggctggtgtacggcgaagtcaaccaccatgccccggctcacaaagttctccaataaaaattgccttgcaagagcgatgttttcctcaagggaaaattcattctgcaaggcaatgtcaaagctgtatgcaagctgggcgttctttccacgctcggctttttccacggcgttccatagggtctggcggtctgcgtattcgggcggtgcatgggacggcaggagaatgtcggagcagatcacgccgcccttgtgggtgtagtcgctgtattcgccgtaatactcgctatacaatcgctccccggctcggtaggcggcagaagcgatagcggactgtcctgcgcttcgcttagtctgcgtgacgctcagatgaaatagtgccatcggctttcaactccttttctctgtttgcttggctgatatgagtaatcgccatgtgacggacggctcgctggacttcggacagggaaaagatgtgttccatcagctctgtcatttcggtgcgtgtgagatctttgacctccggggcaaggctctcaatcgtgccgcccagattgcaaaggcggtgggtgcgcttggtgcgttcgcctttctccagatacttctttctgttctccagacgctccagcttgtgttgttcctgtgcaagctgcgtctcggctcgttccttttcggctcggagctggtcaagggttttcggttttgtcattgtgattgacctccttttttgattttggggataaaaaaagaccgtcaacttttcgcatagtgcgaccagtcaacggtctgattttcggtatttatttttccaaacttgctggcggcgaacagcattttatgctgtttgcggacggcaagtccacaggggatagccgcattagcggcgcaagggggtgtagccaccttgacggaacgaagtgacgcaactttctcggtcgggcagttttcttctgctgacagagaatgaagctccgcaggacgcacatactcccgataggagagtatagaagtgcgccctttagttcctaaagggattttcttctgacccaaattatataaaatgtagatcaagacatttctaagaggtactctcagattttcacaacataaggttcatcttcaataataccctgatcgtgggtaacaatgataaccgttttaccttcttcattgagttcgtgcaataacctcataacaatatctctatttttcttgtcaagtgagccagtaggttcatctgccaaaacaacagaacattttttcatcataagacgagctaaagcaactctctgttgttcaccaccggaaagctgataaacttttttgttaacttcctttgataaccccacacgattaagagcttctttaagtgatactttagttcggcttgattttttaatcaaacttaaattttctttaactgtcttattttcaagcagtgcaaaattctgaaaaagaaaccccactgtatccgcaaaaaaactgtttttatttttaagccgggtaatattcagcccttcgattatgatactgccgctatccggtttttcgataccaccaatcatattgagtaaagtgctttttccactgccgctatcgccgctgattactacaaaacttccatccggaatttctaaattaaagttagagaaaattattttctctccaaatgctttatttaagccacgaattataatcataaacatcctcccttcaatgactttgagatatttgttttttcaacccacataatatttgtgaaaatgattgccatttcaataatggtgagcaacgctccaatcagtaaagcaatcccgacacttgcgttagatataaaaatcgaaacaatgcaaatcaatatcacaacggctatattttctaagagattaacggaaataaatcttttgtgcctttcataaaagcgatagcccaaaacctttttgagggagatttccatcgcattaagtctaaattccattttcacttcagatatgatgatagcgatatctaacagcaatactaatacgcaaagagagcttataaagccaatcagtttcacgaggaaactatgactataaatgtaatcctctccgacattcgtcagcataaaatagtgtgaaccaagctgttctgaatattttttcgcaacactgcgaattgtgctttcatcgcatccgtagattacctcaccattatatgttcctgtttcgatataacttccatttaaagcaacagcctcatttgcctgataaatcacaatcggatttgttactcttgacaatccgtcaatagcctcttctctgttcgaattgagataataaaattgttctctgccagaatattctttataaacaacacgcagttcttctgcattttgggtaagagagccaatttcctcttttgcgatatctttgtatgattccgcatttcttccctttggcacgaagaccacgatatcctctttttcatcatcttcagtaagcatatcagaaaacccttgtagcatatctctggcattatgatttacaaaaatataattatccgtatcgcttatccggctgcctatgcagaccaccggatttatcgtgttgtattcattttcgtaaaggtcattccaaaatttgctctctttggattcctcctcattttcttcaaaaggaggttcaatctgcataactccaaaataataatcattataatgattttctaaaagagtagtgtttgtaagtaaattaccttgaatgctactgagatttgtagttattgtaaaaattgtcatggcagtagcaaatactttaagaccgttcagaagataaaacataccttttttatctgaagcattggcaaaggctttttttacatcaaagcggacaaaagcagcataaggaattacggaaagaactgctccggcacaatacactgccaaaatgagatgatcttcatacgctcccgatataaattgagaaacaagcaactttgctaagacgaataatgcagcatatgaaatcatatcagccactacagcttttagagcaatcacagcagcattttcgcccagagaagctcgtacaactacttccttttgcctgcgtatcacctcaatcatattaagtacaatcatcaatatggcaaccaggccccaaacaatgaacatcatatcagtttcggttgattgccaaaactctggctgcgatatagaatattcttttgccaaatcttgatatgtggcaataatgtcatcatcatcaccgatatagctgaccattatttcctgtccattgcctgtgttttttgcttctctaaaatcttcaaattctattacggtgattccacctatcaaagccgtatatgttttttcctcaatatccattgtgcttttaagactatcccgaacaacggtatcatcaccataaatataaagtcttgtctgataattagaaactctctgattaaaagtcgaaaaaatatgaacaccatgcttctcagctgtatcttctgcattggctaaaaatgaatccatatcgtcattagtagttgtgtatctggacgataaataataagcaccattaaagttccagagcatattttgatatacttcagcttgcataacaaaagcaaaaataatcgtaatcaacagcaatatatttcttatatgtttcatttgaaattcttaaacctcctttgaataggtaacagacacacgattgcccaaaatactaatatggattttttcatacaaccacattctcttgttagattctaattttccgttttctttattcgcataaattgtaccataaaactcgtgaacaattctaccgcaactttggactacatgagaaaagtccgaacagttttctgcccggacttcctcgctcaatcataaatcaattccgctttcacaatctcctctgcctgtgccttgcaagcgttcatctgccgcacccattccatttggtttttggcttttagttgctcggtcacgccgttttgctctgccagtgaccgcacgatcagctccatgcggtttcgtgccgcttcgtcaatctcggcgcaatgctcaaagagcttgtcggatagcaccagctcattgaacagtatcggacggtgcatttccagatacgccttgcgaagtctgccgtagtgtccgaggggcttggtcttgcggataacgatgttcgggataagataatcgccgttctgtgtataagtgatattcatgctgtttgtactcctttcatcggctctctctgcggtaaactgctgacagggacgaacactccctttgcaatatcctccgcacgaatagcggctttcttggcttcgatttctgccttttttctccccttgattttgtcctcgtatcgcttctgcgctccgctggctttacgcttcaagtagttctgatgaagcctgtccttgcgttcctcacgtttgcggatttcctctaattcttccggggtcagctccacttctccaaacgccgggggaacaaatcgcccgacaaaattgaagtaaatctcgacctcctgtgtggtctgtatactgcctttgcggtcacgctcatgcacaaggattttctcgataaactcgttgagcatagcaatggtcagcttgtcgaagttctcgtatttgtcaatcagagcgataaaacggtcagcgtccttttcgtgcttctcgtagctcttgactgccttttccagagcagagatttcagcggtaagctcggtctgctccttttcgtattgagcgtccagagtggcgtatctgctgtcggacagctttcctaaaatgttgtcctcatagattttacagagcaggacttccagctccgacactctctgctttgcggtggcaaggcgtatccgctgtttcttaacctctgctgtctgctggctggactgcgcttcctgcaccacacggacaaactcggctcggtcatgcttcgcatactcggcaatggctttgagcatttcagagacaagggacagtaccacatcttcattgatacggtgctgggtcttgcagagctttccaactgggactttgctgtattgggaacaggtatattgagaaatacgcttgccgttgttggtacggtggacatacatcttgccgccgcaatcggcacaataaagcaagcctgtgaggggagctgcttcgccccagccgtccgggtagcgtctgacattcccacggattttctgcacaaggtcaaaggtctgctggtcaatgataggctcatgggtattctcgaaaattgtccattcgtcctccgggacataatggcttttcttgtccttgaagtgctttcgggtcttgaaattgatggtgtgtcccagatattcacgcttttcaagaatgttgcagatggtggaagaaccccagccgtacacatctttgaaagtcttgtttttgttcacgccctcgccgtgttgggcaaggtaagcagacggaataagcaccttttccgatttcagtttgctggcgatctgatacggaccgtagccgtcaatcgtcatggcaaagatgcgcttgaccacatcagcggcttcggggtcaaccaaccattggtctctggcttcgttccagagatagccgtaaatgaccgtgcctgtgaggtgcttgccggacttgccttttgactggaaagtggaacggattttacggctggtgtctctggcgtaatactcgttcataatgttgcggaaaggggtaaaatcatcgtcccctttggcactgtccacgccgtcattgatggcgataaggcgaacgccacgctgacgcaggatttccataatctgaccgactttcagatagtcacgccccatgcggctcatgtccttgatacacaggtactccacattcccggcttccacttctttcatcattgctaaaaatccgggacggtcaaagcaagtaccactaatgccatcgtccgtgaaatggacaatgtttgtaaagccctgccgggcggcgaactcctccaacatagctttttggaaagagatttgtcaagggtgttttaccattcagcaacgaattaaggcataaacaatatcacatttttataatgctttttgaccacaatcagtccggcactgattgtggtctttattttggaaatgacattttccccttaaataaaggaatcaatcgtcgttgcgtttttcgtcaatatctgccataataaaaagaagtgtaaataaaagaaaaaggggggaattgccatgccgcaaacaccgtttcatgcctattacaaggcccgacttttggaacaactgccggaagcagaacagttccttccggtctttgcatcatcggatattgaaatctatccgtttcagattgcagcggccagctttgccctgcgttccccctatcagaaaggtgccgttctgtgcgatgaagcaggtatgggcaagagccacgaggccatgctggtcatcaatcaaaagtggctggagggatacagccggattctgttggtcattcccaatgccgacctgctgcaccagtggacggaaatgctggagcgattctataccgtcccatatgtggtgctgaccaatcgggaccaatggcggcagaacaccagtgaggacaactccaacgcttttatccaagatgccattgttattactacctacgacttcgccgccgacaatgaggaggccgcaaaggtagttaactgggatctgacggtattcgaggaagccaatgccctctctccagtctaccgggaggacaacaagcaggccaaggccctcaagcggatcgccggagactccttcaagctgctgctgaccggcactcccattgaaaagaacatcatggacttatacggtctgatctggttcatcgacgaaacgctgctgccgggagaaaaagagtttctggcccggtatctgcgccgaccagagaactacccggaactcagcgaacaggtcagccgctattgtttccgtaccctccgttcccaggccaagcactacgccaaggtgacggaacgtgtgctgctgaccgtggagtacacccccggcaaggcagagcggcagctctatgagctgctgtacgcctacatcaaccagccggaaaagcgagcctttcccgaaatgaaccaatatgacctggctctgcggctgctgggcctgttgggttcctctacggcggcaattttgcaaaccatcaaaggtatcgtcaagcggctccaggggctggaaaacgcagcggacgaactaagccaatggcaagagattcaaaccgcagccgaaagcattccccaggatgccaaggccggtgagctgctgaccgttctcaaacagggattttccctgatgaagaaaacgggagccaaacagaaagcggttatcttcaccgagagcgtggaaacccagaagatgctccagaatcttctttctgaccggtaccgcactctggcctacaacggcagcgccgattactccgtgatccgccagttcaaggaggatggcgaggtgctgatttccaccgataacggtgccaagggcttcaatctggaggaggctgctttcatcatccactacgacctgccgtacaacaccttaaagctggagcagcgtatcgaccgctgccaccggctgggtcaggaaaacgatgtgctgtcagtggccttcatcgacaagaacaactttgccgatgttcgcaagctggagctggtcaacaagcggatgttggtgacagacggtgtctttggtattaccgatgacgtgctgggcggttttacagatgatgtaaaagcagcctttccggtcattgcccagcggttgcggcccagggcacagattgagcaggcataccgccagaccctgagtacccacgaggaagataaccggcagaccgtctccgcagcggaggatattctgtttaccaccttcaccaaggaactggccgacaaggtgaagatcaatcccaagtatgtgaatcgccgtggacaggagctgaacaacgacctctgggaaattaccaaatggttttttactcgttataatgaaaagaacgatgattgccgttttgtgattgacgaattcaaccgtacgatcacggccacggagtaccgggaactgccggtgctgttctactactggacggggagccggaaccggccctatcgcagccagaagatgtacggcatggcaaaagacttcaaacccaaggccggacagattaccctgtccagtatcataggccgtgggattctccacgagctggagtgtgccaacgagggagtgctgaccatcccgacggtgcaggcgccgtgccagatagccctttatactgtcaccctggtttcaggctccagccgcacagaacacgccgtactgtgcggtttgacggatagcggcaaggccctggacgatgcagcttgccgcagcatctttgacttgccggtggagagcagcacggaggatgagcggagatccccccactggttaaaaggaaccagccgcccccacccgctggatcggctggtgccgagtgataagatgatggcggagcaactggagcgcctttcgcctgcccaggccgaggaaatggagcggatgaagcagcaagtgtccgctgataaggcggcattgagccgagaactgaacaccctggacagccaggtacagcaggcgcaagcggagctggaggccgtcaccggcgaccggctgaaacgtctggctgcacagaagaaaatcaaccagcttcggcaggaatatatgaagcaccaggagagccagttctttgacgccatgcggctggatatggagctggaagaaaaaatgaaaagataatcgaaacattaccggtgtttcaatagaccacgagtatgtagtgtgttatacaaagcaattcggacaccgggtattccgtggaaccgacagaaaaacagaacaatataagaatcctgacaatgacccccgtggcccttggacaagtgctaacatggtatcatactccggataggcataatgaagcctttccgccacctcaccggataccgccctgaacaattgatggcatagaaataatgcttcccatatgttttcataggaatccatccggtaggtggacaaaagtttctcccacaaatcctcggatatatacctttcaataaacttatagttcttgcctacacttaatttaaagcctgtttcgatgccgaccttccatgatatcattctcagcagctcatggcgaacaatctgattaaaatgatcaatagcaaataaaatttccttacggcacaatcctttaataacataaggtgttacattccaaaattcattgcagcaatcatcatactcccttgcgcttggctttcttacatgataatctatatcagtcggaactatgtcccttttaattctacaatctttatcaattagaacctttattaatttatcgccctttaggtaattatctaactcttccaagggcaataaggtatctttatcttcctctctaagatacttaactagccccggataattgcttatccttacagttcggatcaattagaattagccgaaaacggcggcgaagaaacgaaccaccgagaagcaccgccgcattgccgagcttgataccctcattgaacgactgtatgcggaccggaaaaggcgcggttgaccgccttgccctcaaaggcttaggggcatatcaactatatattggggccgagtgccgttactttaacaccgccgctagccatgagcttatgcttcctttaggacactgtcccaacagacactttttaaagtatgctgcactaatccttatttttcacagcatagcgcaatgacagacagccatgttctgcattctctgttccctgcaattccaaattaactttttcagataacagaaggttatcaaatagttagatgtctaaaaagcttgtagttaaagctttttagacatctaaatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataagcgtaccggttccaattttttcgcagtttaacttttccgacgcatttatcgtcttggtagtaaagatatattatcttatcagtattgtcaatatattcaaggcaatctgcctcctcatcctcttcatcctcttcgtcttggtaggacttgctactgccgatgctcgtccaaatttgcactatgatttaatcaatccggcagatggaagaaactacggatgccccgaaaaaggctggcgatatgatcgaaataccatgaatcggctcattcaagagggcaggattatttggcccgacaacccagatgggcggccgcgcaaaaaatcatttttgaacgagctgtcagacaatcttcctggtttttcatctgttttcagcactggcgtttatacaaatactgcaaccaaggaaattggaggattgtttaataagtatttatttgattttccaaagccagtcgaggttattaagcaattagtttcccaagtgtctaacacggatgacatcatccttgacttcttctccggttctgctactaccgcccatgcagtgatgcagctcaacgctgaggacggtggaaatcggcgctttattctggtacagcttcccgaactgtgcgacgaaaagagcgaggcatacaagaccgggtacaagaatatctgcgagatcggtaaggagcgaatccggcgggctggtaaaatgctaaaagatgcgcttgaaagttccggtttgtttgttcgtgcaatgaaacgccatcaagatcagcatgattcacttgaaggatttgcttatgcggagtgggaagaaagtccagaggtaatcaatgcaaaaaaagaaatggcagcaaaactggatgtgggcttccgtgttttcaagctggacacctccaatctggaaacctgggacgccacccccattgaggacgagcagctcgacctgctgtatcggcggatgaacagcatgattcatcgggtgaagccggagcgcaccgacctggatatgatttatgaaatcatgctcaaactgggtgtgccgctgacctactccgtgacaccgttctccatcaataacaagactgtctatggcgtgggcgatgactgcctgctgctggtctgtctggccgaggatgtgcagcccgaggacgtggagcagatgaccgaatatgccccggcaaaaatcatcatctcccgtgacagctttgctgacgataccgctatggctaatgcctactatatcctgcgggatcatgggattgagctgaaactggtgtgagaaagatatgaataacactctaaaatggtttcatgtaatcacaaaaaccattgtacattgcttacttggaacaatcgaatacattggtattccatttttacttgcttgtctttctacattcatttcccctatctccagcggtaatactttgtggctttggattgagcggattgctttttgctttacgatatacgaagtaattattgttggtgtgcgaaaaatgcagattgacatacgcaaagatgcactattagcactaaaaaccgcctacgaacgagcagccctgtattgtgaaacaggaaatcaagacatatatcggaacttaacttcaaaaatagatcaggtgcttgacaatgggatactaaatcaacttgatgttgtgcagagctataaaaatctcaagctctacatggacagcaaaaatattgttggaatcaaatatgagattatcaatattcagcactccattgaagcagataatctcttatggaactataccctgttcctgcggttatttaagaggtgaacaggcatgaaactgaaattcaagaatcaagccttccaaatggatgcagtcaacgctgtggtggatttgtttgccggccaggagaaaacacggagcaccttctccgtcatggaggaagcccagaccaatttcttaaatgagctgggccagggcaatgctctctacattgaccaggaaacattgaccgccaatatgcacaccgtccagaagcggaataacctgcccctgacccccacagcggaaggctgccagttctgtattgagatggaaactggcaccggcaagacctacgtctacaccaagaccatctttgagctgaaccgcaagtacggattcaccaagtttgttatcgtggtgccgtcggtggccatccgggagggcgtctacaaatcctttcaggtcacgcaggagcatttcggcctgcaatacgacaacgtgccatgccggtacttcatctacaactctgccaagctgtccgacgtgcggcaatttgccaccagttccaatatcgaagtgatgattattaacatcgacgctttcaagaaagcggagaacatcatcaatcaagcgcaggatcggctcaacggtgaaacggctatgggctttattcagaacacacaccctatcgttatcatcgatgaaccccagagcgtggacaacacccccaaggccaaggaagccattgccacgctcaatcccctgtgtgtgctgcggtactccgccacccaccgagaaaaaatcaatctgctttaccgcctgactccggtagacgcctaccagatggggctggtcaagcagatcgccgtatcctccaatcaggttgccggtggcttcaatcaagcctatgtgcggctgctttccgtcagcaacgacaagggctttaaggccagagtggaactggatgtgaagggcaagaccggagccgtgacccgcaaggccatgactgtcaagccgggcgacgatttattcctgctgtccggcgggcgggaactgtacgaaggctacaccgttaccggaattgactgcactcccgattttgaacatatcgagtttggcaatacccaggaggtcaagctgggcaaggccattggagacgtggacgagaacatcgtcaagaaggcgcaaatccggcgcaccatcgaaacccaccttgacaaagagctgcggtatctggacaaggggatcaaggtactgtccctgttcttcatcgataaggtggacaagtaccgccacgaggacggcacacccggcatctacgccactatgtttgaggagtgctatcaggagctgatcgcaaagcccaagtatgcgctcctccgagagcgattcaccacagatgtgagcaaggtacataacggctacttctctcaggacaagaaaggacgcctgaaggacaccaagggcgacacccaggccgacgatgacacctacaacaccatcatgcgggacaaggagtggcttctcagctttgagtgtccgctgcggtttattttctcccactcggcgctgcgggaaggctgggacaaccccaacgtgtttcaggtctgcaccctgatcgagcagaagtccacctttacctgccgccagaaggtgggccgtggcctgcgcctgtgcgtgaaccaggacggtgaacgcatcgaggacaagaatatcaatgtccttcacgtcatggccaacgagagcttttccgagtttgcttccaccctccagaaagagatcgaggacgaaactggcgtcaagtttggtgtactccagctcagtttgtttgctgggatgacctatcaggaagaagttacccgtgagcatacgattgacagagaagaggcccacgagctggtaaaaacctggatggacgacggctccattgacaaatggatggccgaccccgaaatgacggcagcggaagaaaaaattacagcggaattggaatcagggaaaatcaccgaaccgcccagccccgtaacggaagtcatgcgccaaattaaaaacggtgcgaccgctgaacaggcagcagaggcaattattggaatcaccagtacaatcactaccgtagaggaacataccgtcacccacgaggaagctacggagctgctggagcattttgagcagaaggggtatatcaccagcaccggtaaggtcaaggataccatgaagaacgctttgaagaacggaacccttgacctgccgaaaaaatatgaagctgccagagagcgttttgagcagattatcgccaatgccgaccggaagcccccggtgcgggatgcctcccgtgatgtggtggtacggctcaacaaacaggtcatgctctccccggagttcctggagctgtggagcaagatcaagcagaaaaccgcctaccgggtgagcattgacacagagcagctggtgaagaactgcgtcaaagcctttcaggaaatgccccatatccccaaaacccgtctggtgtcccagactgccgatattcacatccagcagtccgggatcagccacatggaacgggaaatgcggacgatggagattgccaacgattatcaggccctgccggacatcatcaccgccatcagcgatgaaacgctgttgaccccggctaccgtcaatcggattctggtagagagcggacggtgtggcgatttcctcaacaatccggaggcatttctggagcaagccgtagagctaatccgcagccaccgccacgccttggctatcgacggtatccgttatgtgaagctggatggccaggaatattatgtgcaggaaatcttcgacaccacggagttgcttgctaacctggatcgaaacgccgtaaaggtggaacacagcgtctatgactatgtggtttacgacagctccacggtagagaagccggtggcggtggccctggacaacgacccggatgtgaagatgttcttcaagattcccagccgcttcaaaattgaaacccccattggcacgtacaaccccgactgggctgtgtatctgaataagaacggtgaggaaaagctgtacttcgtcctggaaaccaagggtgacaccagctttatgcacctgaaaaccagtgagcagctaaaaatccactgcggcaaggagcatttcaaagcactggacgcaggtgtggagctggagactgcaaccagttggacggagctgcgcaagcgcatttgacagagatagaaagagctttttatctcacatctcgtccttgattcttgcgctttcccttgttggaaatctgctgctccttctgcgtctggcgcaccattctccgcacggccagccgctctgcatcctcgtccagcatccgggacaccgcctttttactgtcaaacatcagaagtgggctgtacttctcaacgtaaacctgctgtgcctggttctccgcttcctgttctttgccggggcggatggcctgtcttgcttcatacagctgcactgggtcgaagccctgggcctgctcccgaagcccggcatactcgttcagggcagcgtccaactcggcggaatatttctgttcctgttcttccagccgtttcaggctctgctccatggcggcgatgtctttgggaaatttatcggcggcatcttcctcggaatatgccagcgacgccagaagcagatttttctccgaacgcagttcctccaaatcctctgtcagtgccgcaatcttagccgccagttcccggtgccagaatacatgaaccgcagagagcgcctttttctcggaaagcagactgcggcgctccttcgtcttatcccgaatgtcctttgcaagctgattgtactgtgtgagggcagggcgcagcgtattcagcgaagcattcaggcgttccttgcccttgcggagataccccagctgatagcagaacagaagcaaattttttcgcagattctccatggtctcggcgagcgccgggatggtatttttaactgcctgcgccagctttttgacctgtcctctcagctcccggagcagggcattgtccgccttgatctgccggtttagttcgcaccggtcagagataatgccctttttctccatggctctggcaaccacaccctcatggaccgtgggccgctccagcagagcacgctcggcatggctgcggtggtcgatgcgttcttcgtgcccggtgcgctccagatggcggtttgccacatccgcccatgcagcccgccacaaaacaagctgctcgtcgctgttccagtgttccgtgatgggattttgcctgccatatttggtgcttttaggatatttggatacccgttcatagccctgcgcctgcgctgcggacggggccatatacaccttctttttgcccactttgtactggtactgtttctcccagccgtcggcctgtgcctgtttgaactcagcggcggtaaagccctgttcttcgccgtctttgacgcagagatattctttctcggtcttgtactgccattttcccttttcatccagcgggcgcactgtcagcaggatatgggcatggggattgtgtccggggggatacgggtcatggatagcagcatcagcgcacattccgtctgccacaaactgctccttgatgaaatcttgcaggagctgaatctgttcctcccggcttaactctatgggcagcgccgccacaaattcacgggcaaggcgactgtcctttgcggtttcggtttcctccacagcgttccacaggatttctcgatcctgccactctgcgggggcggtggctggcagaaaaacctgccgccacccaaggccctgtttgcgggtgtagtcgtgctgcaccccgtcatactcgttgagcatccgggaacagctcagataggccgcagcagctacggcggagcgtccagctccacggctgactattttggcctccaaatgataaatcgccattgtctatcgtcctttccgaagggctactgtgaaacgcagcagcccttcttccgtactcgattacaacaggtacgtcgtgaaatgcgacgtaccaccagcaggggtggagcgaatcgttccacccctgtatctgtgtcaagctgccggtggcaggttgacgcaggcaggcggcgggatggggtggcaatataccaccccatgaacaggggattccaaaacgaaaacccctgcgccgactgcatgggcaaggctggcagtttggcagaaatgcagccttgtccagcggctcccgcaggagtcgcaatccctctcggagagcgcacgtgcccgaccaacgggagggctaccaccgcctgctttagcaggtggtgagtaagtgcgcccttcgggatgaaaaagaggaaggcccccggtttcccggagacctcccagccattttcaatcgtgcgctgccagctttcgccgcaggtattcttccagattatcaagccctaccgcctgtacttccggcagcactttttccagcacagcgccctcctgaatgagccgccttgtccgggcttttcgtgccttcacccggtcccgtgcctgggcttcctccaagcggtgctttgcctgtaacagtttcttttcttcacttgtcataggtttacctccgtttctgccagatcaggtcatagcccagcacatcggccagctccacgacctctttatagcgaatagattctcgctggagcttggcggacaggttggaaacactgtccgaccagccgtattcctcatgaagccggtcaaccagctcctgcatggtgtatcccgcccggacgatctgtgccttaatttcgttgcgtaccgtcatcatcaaaaatcctcctaaatttacttgataaaaaagcgaagccggtacgccctctggcatagccgcttcgctgtgtcgtgaaaaattctcttatcaataaatccgttcagaattgccggtgtgatgtcccgtccataggtcgcaccttccgactttcccgttccgtgtgacttggtttgaaaccgtgcattttcccatggttccatgcactcggttcaccggggtgagaagcacggtttcgcaaaatgatttcttccaaccgtcaaatacttttcgattcccacttgccttgatttacccctccgattttgccagcgatttttgatatacaaccgctgaattgctataaaagggagaacaactgtcaatcaaagcgtacgtacgtacacgattcagcgccgccattcctccggcacatcttccggtacgtacgtacgcatcgaatcgccggaaaacactgatatatgatttctcaccaatacttcaacccccagaaaaccacgcacccgccgtccggctgcgttggtcacattgttgcagtattccagattgtagcggctctggcaggcgatcagagcttcgctgaagctgcgtggtttcagggcaggcaggttgttctcggtgcagtaaatctggtatgcttcgtacagttctttggagctggcagatagatcggctttcaggcgaacatacccgtcagaatccagaaaatcatagacattgttgttgtcccgtttgactgcctcccggttttctctggtgcggtcactttcggtgaacttgaagttgttggcggccagccgctgcaatccctcaaaagcccacagcagaataccctccacctcggctttcatcttctcggccaggtcgggatcatccacacggccagccggtttttcttttgtggtcagcaccagctgacggcggtaaaatccgtcgctccggtcaaacagcgcctgcaaatctccgttggagaaagccagcagccgggcgcacatccatccctgatagctctgcttgcccttgcgctccaaatccattttgccctgggcggtgacgatggattttacatagttggtctggcgcagagcctccatccgcatatcgtcatccacgcacaggaggatatgctccagatcagcacgggcaaaccggttctcggatattttcccgatgctgccgtccttcatgttggaaccgaacaaagttcccagcacagcgccgatctgcgactttccttcgccgccgctgcccttaatcaccatcatccgctgtcccttattgctggggatcaggcagtagccgatatattcctgcaaggtgggaatatcctccgggtagagcagaccatccagaaattgcagccagagaacaggctttggggcgttggggttgtaggccacggggaaacggttgcggacgttttccggctttccctccgcaaaggttccatccagaaaaagcgtcccgttggaaaggtgaatccggtccggctccgggggaaaatcctccaccagcgccgccagcttcatcagctccacaatgttgctgattttgcggggaatgttgctgaccgcacagcatttcagctcctcaaaaatctctccccgcaggggcagttcgtctgtcacacggccttcgggcgtgaaaaaagccccgtttgtgaagatgatcttgtgcgtctgcaagaactcctcacaaaacagggcttcgttgatgctttttccatcaaaccagacgggcatcccgtcaagctgcgctttgtttttcatgggcatcgtcctcctttttcagcctgtccagccgttcctccaaaccggcgatcagaccatccttgttcagcatttctacgatttttacccgttgttccagctcggcggcaatgagcaaatctgccagatactccacatagtccagcatctggcaggcttccacaaaccggtcatccagaacatcttccggtgtcttgggtgtgtgctgcaccttccagcgttccagaagatgcagataatcgcacaatacccgcaggcagcgcacttgctcctgccggtatgctttcagcaggggacgctccggtttgggcagggcagctgccgcaggcggcttgtccgggccaatcccaaaatcctgggccagcttctgtgctgcctcgtagctgctcaggtcaaacagcttcgccacaaggtcgatcacatcgccggtggctccgcagccgaaacagtaaaaataacgctcgttcagcttcatgctggggtgccggtcctcatggaacggacagctgcacatcccgtttcggctgacttgcagcccatagtgttcagccgcatcgggcacacaaatattctgttttaccagttcaaagagtgtcataaaaaatccctccgtttcagggcataaaaaatgcggcctgcccggtttatttgggcaggccgcaatccttatgcagtttgtgatgcttccgtttctttggctttccgcttttcctgccggtagaacttctcccggcaggcgggtttgcagaatttagcgttggggcggatagactggaacgactctccgcagcactggcacaccagctggtacggttcacccggaacgatcagcccttcggcaatcttctgtttgcgctccttctggcgcagatatttttcatggtcacggatgcgcttctggcggcgcttttcctccgcagccagttcttcctcggtgggttcgggcatgggcacttcaaatttcccgataaagttcaggtaaatctcgatttcctgaacccgttccccggtgcttctgtccggggcatggaccagaatcttctccacaaattcatggatcataggggcggtcagctcggtgaaatctgtatatttctgtgccagcgccagaaagtgactggcacggtccgtgtcctcatggaactggttcagctgcgcctgctcggaggcaagcagctgttccagctcggcctgttccttctcatattcggcacacagcagctcgaaccgtttttcctccaacttgcccatggcataggtttcatacagctttttaatcagcacgtccagctcggcgctgcgcctgcgctccttggcgaccttgcgtttcagctccttggctgcttcctgctggcgaacctgtgaaatgctgcgaaccttctgaataaattcctccctgttctggatggcatagctggcggtagtgcggatggtttccagaatcagggcgttcagagccttggtgctgacgctgtgggaaaaacacatctgggtttctcgttcgatggtcaagcagtaggtggaacagttataggtgtcgtttctgtactccttgccatctgcccgtgtgtgtttgccccggtggttatacatctttgctccgcagtcggcacagaacacaaggccggtcaggggattggcgacgccagtggtatctgtccggcgcaccgtccgcttcacctgctgggccagctgccaggtttccgggtcaacaatggcctcgtgggtattctcaaaaatcagccagtcggacgggtcattttttacccgcttatcccggtaggactttttggaggaacggaaattcacggtatgccccatatattccggtttctccaacatggagctgaccgtaaagccgtaccagtcataggggcggctggtgtccacggtattcttccggctgcccctgccgttgcgggccagataataggcggggcactccaccttctcggctgtgagcattttggaaatctcataggggccgtgtccctccaccgcaagccggaaaattcgccgcaccacagtggcagcttcctcgtccaccagccagtggtccttgtcctccgggtcttttttgtagccatagatggcgttgttggtggtgggcttgcccgccttgcccttgacacggtatgctgccgaaacctttttggactggtcacgcagataccattcgttcatgatattgagaaagggggcaaactcgccgctgtcctgttcctcgctgtcaatgttattggcaacagcaacaaaatgaaccccattctgccggaacattacctcggtgtaaaagccggtttgcagatagtttctgccgatccgacttaggtccttacacagcaggtgggccacctttcccgcctcgatgtccgccacaaggcgcttccatgcgggacggtcaaagttgccgccggaccacccatcgtctgtgtagtggacgatattggtgtagccccgctgtgctgcatagctttcaagataacgtttctggttcagaatggagttcgagtcgcccgtgaggtcatcgtcacgggacaggcgctcatagagcgcagtgattttttcttccgtctgtctgtttgccatatcaggcgctcctttcagacggacggctcatttgtggcagttccattataccacattccggctggtttgccagcccgtcattgcggatcagccgcagaattttatcttccatcgtttcctcggcggtttcgctgaggtagacacgaactttataggtggtgttgccaatgtgccgggtcagaaacacggcgtttttatctgccatagaacctctctttcttgcgctttcggcgcatccggtgtatactgttgttatggttccgttatttgtaacctgcgattatgttacttttttgtgtcaagcctgaacatggcgaaagccccctttctcctgtgtgaatgagcgaatgtaacccaagtaacttgtttttagattactctttcactaataggagaaatccggggtgcaaaacggaaccatttttgaaaaatcgcaaaatatttttttgaaaagaggtggggtcatggcgtatctgtctgatgacgagcttctggataccgagggtggcttcaccggatgggacgatgagacaggcgctggtgcaacggaggaaacgctggaacaggcgcttgcggaagaacgtctggccgagctggaaagtgagctggagcaggacgagcatcccatcgactatgaagcggagctggaggacgaggaagaagaagccgccccggtcaacgaaaagcggctgaaacgggagattcgagcggaagctgtgcggcggctggaggaagcagcacgcacggagaaggatttccgggccgtggtggaggaatggaacaagctggaccggaaccgggagcgccgggaacgggaccacgaaaaccttcgtggggatgtgccgctggaatatcaggcggtgccggaacccaagctcattccccgctggatgaacaatcccgcataccggcagctgatggccgggaactttctggacatcctgtttgactgcccctatgagatgcacaacctgaccgctgacgcctttatatcccgcatggtggaggaattaagcgaggaacataaggaagtcctgtatttcctctctttgcggctgtacagcaccacccggcttgccgctgttcgtgggcagtctgaccgcaacattcgcaaactgcggaaaaccatccacaagaaattgcagcgccagatgtatgaccatctgtgcggcaagcaggagcatggcggcagcctgaccttgcgggaacgccaatttttggaggaatactcgaaaatcgcaagaaaacagggcaaggacgccgtgatccggcgggaaaacaagaccaagcgcagaaaaaagaaaaaccgcccctgataattgggacgattaaggagaaagggcgtgtatgatgaaaaatttgtttgaacagtcccgttcccattgggtgcggtacgatcactacgagctgaaaacagcggaagatggcaagcggtacatcacccccggcaagagtgcaaagccggatgtctacaatccgctgaaagaggtccccaacattgtgctggatgccctgaatgtagggatgttgatgatgggacgcaagccggaagcagaagtggaaaaggcagtgatggagtttgtcacccggtacggcctgctggggctgatgaccgccctgcccaccacgccgtcttttatggactatgaggcggtgtacctaccgaaaaaccactttattaaggaagaatccatggcgacggacaaatatctgtccctgttttatccctttgatcagctggatttggtgaagaaaggcattgaatccacatggaatgtgtccggtgaccggacgatggttgccctgaccatgaccttcatggacgagccgatggcgaagaacatgagcttccagcgggaatatgcggaaccctacgactgggttgcccagcagttcaaagattgggcctttacactgaccaccgccattttgtactacaatgactatgattccattgacgaggacgcacgggggctgtatcgcaaggccatggctgcgttcggcgggattgcccccagctaccacattgagctgttggataagcccaccatctattgggatttccattcgctgctgctgggcatccagatgatgttcagcttcatgctggtagacggtgaccagcccctgcgcctgtgcaagcactgccagaaggtgttcctgggcagccggtccaatgccgccttttgcagcccacggtgcaagaaccagtataatgtctacaagagccggggaaagaaccggacggatggaggtgacgaggaatgagcgaggaacagggactgaccccgtatgaaaccagagaaatcctcttttacaagaccgaaaacggagaagtgcgggtggaaatcctgctctttcaggaaaacctctggctgacacaggcaaaaatggcagaactgttcgaggtgcagaaagcggctatttccaagcatctgaaaaacatttttgaatctggagaactgaacgaggattcagttgtttccaaaatggaaacaactgcggcggacgggaaacggtatcagaccaactattacaatttggacgccattatcgctgtggggtatcgtgtgaactccaaaaaggcgaccatgttccgcatttgggcgaaccgggtgttgaaagagttcatcatcaaaggttatgtgatggatgacgcacggctgcgggagccggagaactttttcggcaaggattattttgaggaacagctggagcgtatccgggacatccgggccagcgagagaagattttaccagaaaatcacggacatctattctcagtgcagcgccgactacgatgtggaaagccccatcacaaaggagttttttgccacggtgcagaacaagctccactatgcggtcacccatcataccgccgccgagatcgtatacgaccgtgccgacagcaccaagcccaacatggggctgaccacatggaaaaacgcccccaaaggccgcatccgtaaatcggatgtcaccgtcgccaaaaactatctgaacgaaacggaaatgcgaaacctgaacgagatcgtcaccatgtatctggactatgcggaacggcaggcccgccggggaaatgtcatgtatatggccgattgggtcaagcggcttgacgcatttttacagttcaacgaggaagatattctgcatgataagggcaaggtgaccgccgctattgccaaagcctttgccgagaaagagtttgaaaagttccgggtattgcaggacagaagctatcagagcgactttgacaggctggttgcggaaacttcggatgatctgacagaataaccatatacacagaaaacccacgcttccggttctctttccggctgcgtgggctttttcggccatcgcttatttcttgttttgcagctgttcataggcttcctgatggacgatcagccctgccgaaaagccatacttgaaatggctctcactttcctcgcattgggcgatagcgttctgcgcccggagttcctccaccagcgcatagtcctctttgctgagccgctgggataactgctccatcaacgctgcacaggtttggatcgccttgtggtattccggggacgtgggtacgactgtttcacagggataaaactctccattatacatggcttctaaaatcatggtgttccctccctcaacagtagaccagctcagccaggacaatttcctcggctctgttgtggatggagttcatggagcgcacccatgccatctggtcggcagctttcagggcttctgtgacgccctcttgctgcatcatggatttttcaatgatttccagccgctcccggcaggcgatgtcgatttcctccaagtggggaagcagcttttcagtgacaatgagatcggtatacagaatgggccgatgttcttttaagtaggcacggcgcatccggccatatttcccgatatggtactctttggtgtctgctaacacaaggttgggaatgagatagtcgccgcattgggtgtaagtcagttccatacaaggctcctttcgtgagaatgtggttgacagttacggtaggtttgagggcatccctcctttatcataactgtcttttcattcgccacaaatgagccgccagtcatgatgtaatgttttttggtgtaatccaccctctatacattacatcatgattggaaatggaattgctctcacgctgttggtcatcatctttgccgaagtcatcacggctcagtcgttcgtacagagctgtgattttctcgttttttctcataacttgtgctcctttcttcggttttaggttgtgtgttctaagagacttcccaaccgcttgattaagaagtcttttagagcatacaacaccggctgccagcttatatttcttatactgccgcactgcgaagtggtttggcttttccgattccagtgcatcaaacatcaggtctacaggatttttgaactcctcgtcatcctcccggacttccatggcgttgatgaactcgatgagggtggagaagttttgctcctccaccggagcttcatagtggatatatccgatcaatgcgcaatacagcaatgtttccgccttgacccagaaatcgtctccagccttgccttcgcctttggtattggcgatcagcgttgttaccagcttcaagatgtccttttcgctatggatataggcgaaagggttatagtgcatggacttcttgaagttgattgtatttaggaccttgattcggtacggctcataaatgaccttgccgtgcttatccttcatgggctttccgtctttccccggcttgggtgcgcccctttggagcatttttccgcactccaccaaaatggttcccttcgggtcagtcacgacgtagctgctgtgcatctgcatcagattcggtttgagccagaagcgggtcttaccggaaccggagccgccaatcaccagtacatttttgtttctggcagtctttgggtccttggggcggctgttcatggtcaggctctccgttttcgtcagaatcacattgttctgaaatacaggatcaacgtaaggtgcaatatcctcacgggttccccagcgggccgaaccatattccaatccatgtctatatttcttagcgttcttgcttttaagataaaccgccagcctcagacagcctccacaacacagccctaccaacaagtccaatggatgcaggcttggccagaaactttgcagcgccccaggcagaaccgcaaccagcgaaagaaacttttctgaagcatccgccccttgtgccattcgccatgcctctccaaaattggtagcaaacagccccagcaggatatacggcatattcagcaaaacgagctttttgatgtccaatgtctttttcatcgttccagctcctttcgcttggtgcgatccaccacagcatttttgaccatctctttgaactgactgagttttgccagcacagacgggcgttccgttttctcggccttcttgacttttttattggtgtactctgtaaaggctgctgtcagcgcatccgcatcgcgacccttgaagaaaatcaggtactttggcggagaactgctgcggtcctttttcaccgcataatccacaccatatttccgggcgattttctcaaactccttgatagaggggtctgtgatctcaatgttggatattccctgattctgcccgacaagctgcttcacagtctgttttccatgcggaacaaccggcgcatcacggcttctctgtttttccagcttcttttcctttcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaatggtcatagtgcagattgccctggcgtacctttgcgtggctcaaaatcttaatctgccccttttcctgactatccagtgctttttcataaccggtatccgacaggaacaggcgggttcgttcgcctttccagccaacaggggaatcgtttgtcagcacatcaaaaataatcatgtgccgggtgtcctccgcaaaacgctggaggtccatatatccatgaccgtgataattctgcgctcctgcctttgcccgcatttcttccatcagctgccctatggtctttccctcagacatcatgcttgctcctttctcccggcagttccgggcaataaaaaagcgaccatttaccagccgccatacagatcgtgatttacttgtgaggtgtaatgattgcttatcgtggtcggtgcattgaacagaacggtcagaagatactgcttcatgttgcgaatttccgtggtgttcttctgtaaacagtccatgacaaactcaatgtgcgagttatccagcttcaagaacctggaacgaacgatttcatgcggaaaatcgcttcctgcaatacgggtggtctttcgctttgcacagaccgtttccacgattagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcgcaatcccggaagggaatggaatcggtacttgatccataaatattttgtttttgagtatttgatttctctatatttaattctgcgggcttttccgtatccggtttatccatatacgggttttccgtatctggtgaatccgtatccggttttctaagctgtggctgctcgtatatgacatactctatatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagataacatcatggaaagcagtcccttggcttttaacgacaggtttgcatttcgtaaatgatgattgctcatcacggtataatcacgggtccgttcaatgcgaaaaacggccatcgacctcactccttccgaattttgggtacaaaaaaaccgcaatcctcattccaaagaattgcggtgttcaacacttttcaaattttcttgcatagaaccaaaacagcggctttcgaggacgcgcctctgtaaatggctcctcctgggcaaaaggaagtgtttgcatcactcggtcaatatcagttgattccatgtcatgctgagatttgcaatcttcccggattgcttcttgaatttcctttaccgtacacatagtcattcctttcctttcgttgtatgagtttatgagcggcggcgttttcccggtttgaaatcgaggatatgtccctcaatcacacgagcgtaacgcttgatcttgatctcccggcactgctggctttgcagggcagcctgatacccgtcctcggtcaaaaacagccgcatttcctctccggggctgccgtaagctgtgctgggacgcaggacggaaaactcaatcatccagcgggtgttatcccaaaatctctctacggcgagaatcttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtgtcagaggtaaatgtcactcggtccagatcgcttttcttttcctcacccatgatgacacgcatcatatcgagggtcagatgcccctcctgactgtattttttgagccgctgggcttgagaaagagaaggggtagcctgttcgctgtccatcgcgtccaacaggtctacctgttcctcctttttgagaaaggacagctcataagcaggatttaaggcaattttcttttcatccaccatgtccatcaattcaggaatcagctctgtcagacggatatagcgctgaatttgatttcgactttgccccacctgttcagcaagcaactggtctgatcgcttttgtgtcccaacttgggacacattttctttactcggtctgccagcctgtcttttcatggcatccagcttcatcttgtaggcaaatgctctttcactggggagcagactttctcgttgcaggttgctgtcaaccataatgatcgtggcggcatcatcatccaaatcccgaacaatgaccggcatggtctccttttctgccagctcactggctctgtgccgcctgtgtccggctaccagctcataaccgccctccgggtctggtcgagcaatcgccggaaccagaacgccatactgcttgatactgtctgcggtttccatcatggcttcgtcatccttgactttgaatgggtggttcttaaagggatgcagttcagacagcggaatctcctgaatcttttccagctttgcatcctgacggccttcttcggtggagaacaaatcatctaccgaggccagctctatttttttcgcgctgcttttcaagtttcaacacctccttcgtcagatttcgatacccctctgccaccttgccgccagggtcatgggcgaaaatactttttccctctgcgctgatttcctttgcccggacagaatgggggatttccgttccaaagactttgattttacttccataggtgtcccgcagcaaagcagcaatctctttggcaaagttggtgcggttatccaccatcgtcagcaggataccgtcaatctggagctttggattgatctgccgtttcaccttactgaccgtagatagaagctgttccagccctttggcgggcagatactctgcctgaacgggaattatgatcctgttcgcagccgccagcgcattgaccgtaagcattcccaacgagggctgacagtcaatcaggatatgggaatattgtcccttcagtgtgtccagatattgccgtaaaatcgtttcacggctcatggcgtttaccaaagaaacctccataccggaaagctgaatatccgcaggcatcaggtcaacgccttctgcatgatgcagaataccttctccggggcgtataggctgatccatcagaattttgcccattgcatccgacagtgtaaatggcagcttgtctggttgcggatttcccaagctgattgtcaggcttccttgtgggtccccgtcgatcagaagcactttctttccggcctgtgccagacctattcccaagttcgcacaggttgttgttttgccaacgccgcctttctggttggcgatggcgatgatttgtgtgttcatgacttcacctcatttctgattgttgctgttgtttctggaaatagaaaaagccgccacttcaaaattaacagtgaagtgacggctctttctatcgccggaatacgagttcctgaaatgaaaaaagcacccagcatttatactgtgtgctacatcaaattcatattcaattattcaaattagctcaaactatgccaaactgccacagccaaaaaacgaggggaaggagggctgaaaagcaccccaaaaatcggctctcggttaaccactttgggaaccacttccccctctttttgccctctttttggccagttaaccacttgcggaccactaaaaattggatgaaatcggctctcgttttgccaaatttggtcaaaccatatcagcccgtttagatatagcaaaagcccggaaaaccttgattttccgggctttttgaaccattttgatatagtctgagcagtcgattatcgcttgctgaactgcggagcacgacgagctgccttgagaccgtatttcttacgctctttcatacgcggatctcttgttaagaatccagcggactttaagatcggtctgtaatcagcatctacgttcagtaatgcacgggcgataccatgacggatagctcctgcctgacctgtgtaaccaccaccgcgaacgtttactaatacgtcaaacttatcagctgtctctgtagctgcaagcggctgacgaacgataaccttcagtgtatctaatccgaagtattcgtccatatctcttttattgattgtaaccttacctgtacccggtactaagtatactctggcaacagatgattttcttcttcctgttccgtaatattttgcgttagccaatgtcttttacctcctcattaaaatgttaaagcttctggcttctgagctgcgtgcttgtgatccggacctgcgtatacgaataactttgtatacatctctcttccaagaggtcccttcggaagcattcccttaacagcatgctcgatcactctctccgggtgcttagccatcatctcttttaatgtggtctctttcataccgccaacataatcagagtgattgtagtaaaccttctgatctaacttcttaccggtaacctttaccttctcagcgttcactacgattacgtaatcacctgtatcgatatgtggtgtaaagattggtttattctttcctcttaataccttggcaacttcagatgccaggcgtcctaatgtcataccttcagcgtcaactacataccattttctatcaatggtagctgggctagccataaaagtcttcatcgttattcctcctagaaaaatgctgttcatctcaggcagcgtgaatgtccggcacactgtcctccatgtcatattgtttatagttaaatggcactccggggctttggaatgacatttattcactatcacagacttacatattatattacacgactccttgcgtgtcaatatctttttcttccatatattcaattcccatcatggtcagtccgtgcgccggtgcggtcggtcccgcagcctccctgtcgcgcgccgcgaggatctgctctatctgctccggctcgatctgacctccgccgacctgtatcagcgtcccggcaataatgcggaccatattgtacaaaaacccgttgccggtcacccggattgtgatgatgtcgtccgcttttgtgacgctgcacgcatagattgtccggaccgtggtcttcacctgcgcgttgaccgcacagaagctcttgaagtcgtgctctccttccaggtacaccgccgcccggctcatcttctccacatccaggctgtggtggtaaaagtaagtatccagccgtctcgtcggcatgcggaatgtccggttcaaaatgcggtactcatatgtcttgcggctgttctgatagcgcggatgccagtccgcaggaacctcgcaggaatcctgcacgacaatatcctcgggcagacgctgattcagcgcaaacgaaatcttatccgccggcatgcgcgtcgtcgtatcgaaaattgccacgtttcccagcgaatgtacgccggaatccgtgcggctcgcgccggtcactgtgatctcctcccccaaaagcgaggaaagatggcggttcagcacctcctcgatcgtgattccgttgggctgcacctgccatcctttataattcgtgccgtcgtacgccacgatcatttttacacgttttacctctttctccaaaccatttctccttgcagctttattgtggccacggcacaaagattctgcacagaataatgagcgccagatacagccacatgatcagataggacaggcggtcgcgtccctcatagcgcagcggcttcatcttcgttctgccctctccgccgttatagcagcgcgcctccatcgccattgcaagatcatccgcgcgccggaatgctgacacgaacagcggcaccagaagcgggatcatgcttttgactttttttaacagattgccactctcaaaatcggctccgcgtgccatctgcgctttcatgatcttatccgtctcctcaatcagaatcggaataaagcggagcgcaatcgacatcatcattgcaatcgcgtgcaccggaacaccgatcttagaaagcggcatcagcgctttttccagaccatctgtcagctggttcggcgttgtggtcagcgtcatgattgaggttccgagaatcagataggtcaggcggatcgccatcagcaccgcgctggtcacgccttccttcgtgatcgtaaaacgccagacgcttaccagtgcctcaccgggcgtcaaaaacagattgaacaccgccgtgattaacatcagaatcatgattgcctttaatccctttaccatgaacttaaacggcaccttcgacagctttatgactgtaatcagaaataccgttgcaatcgcaagcgctgccacgccacggaagcagaacagggatatgatatagatcattgtactaaacagtttcacacgcgggtccagtttatggatcacagaatctgccggataatactggcccagtgtaatatctctcaacatgtataaacttcctccctaccggaattcttcatcggcgcccgccggtgactctttcctccgtaaaatgattcctgccgcggcacaccttaccggtgaatatcgctcctgccggaatcaattcccgtcaatgcctgcatcaggctggctctggcttcctccaccgtcgtcgcctccgtatccacggaaagcccgtgctccttcagttcgtgcatcaggtaagtcacctgtggagccgcgagtccgatcgtctccagctccttatagtgccggaacacttccttcggtgtgtcgtcgaacatcacctgtccatggttcatcacgataatgcgctccacatacttggcgacatcctccatactgtgcgacaccagaatgaccgtcatgtttcgctcgcggtgcatccgtgccacaaggtctaagatctcgtctcttcctgccgggtcaagtcccgcggtcggctcatccaggatcagcacctccggcttcatggcaagcactccggcgatcgccacacggcgcttctgccctcccgagagatcaaacggcgactggtaataaagctcctccggcataccaacactgcgcagtgcctcaaacgcccgcagtcccgcctcttccttggaaagtccctggttcttcggaccaaagcagacgtcatcaaaaattgtcgtctcgaaaagctgatgctccggatactggaacaccagtcccacccggttgcgcagttctctcaggtcaaaatcttcctcataaatatcctgtccatgaaaatagatcgttcccgaggttgccttcatcagaccgttcaggtgctggatcagcgttgacttgccggaaccggtatgtccgatgatgccgatgaactgtccgtccttaatctcaaggttcacatcctttaacgcctgaatctggtacgcggtctcctcactatatacaaaattcactttatctaaaataattgacatttctactctccgatctgtgccacacgaagaatcgcgtccacaagttcctggcggtgcagcacaccgacgggtacatcaatgccggactggcgcagcagatctgctaaaatcgtcacctgcggcacatccagtctgtactccttgagttttcccacctgggagaacacttcccgcggtgttccctgcatgacgacttttccctgatccatcacgatcaccttgtcggcgtccacgacttcctccatataatgtgtgatcaaaatgatcgtcacgccttttttccggttcagttcatgcgccgtgcggatgacttccttccgcccgttcggatcaagcatggcagtcggctcgtcgagcacaatgcacttcggttccatcgccatgaccccggcgatcgccacgcgctgcttctgtccgccggaaagcttgttcggcgaatgatgacggtacgagagcatccctaccgcaccaaggctttcttccacgcgcttccagatctcatccgtcggcacgccgatattttccggtccgaagccgacatcctcctccacgacgctcgcaatgatctggttgtccggattctgaaataccatacccgcagtctgacgcaccgcaaatgtattctcttcctttgtgacatccctgccatccacccagagcgagccttcgctcggcagaaggagcgcgttaatgtgttttgcaagcgtggatttgccggaaccattgtgtcctaaaatggcaataaaatctcccgcttccacatccagatcgacgtggtcgagcgctgtggagatggactccacattgccctcctcatcgcgtctgatatattcatgaaccaactgtcttgccttgataattcccatctgtaccctctctaatcttcccagcgcagccggtgcagctcgccctgcagcttcatgtggtcaaactcattctgccgcaatgcctcatacagcacaatcgcaaccgaattggataaattgagtgaccgcgtctcgccgatcatcggaatccgcacacaggtgtccggattggcttttaagatctcctccggaatcccggcactctcttttccaaacataatgtagcagtccggctcataggatacctcagtgtatacatgtctgcccttcgtcgtcgccatataaattttagcgcccgggttcttctcgcagaaatcttcccagttgacataggtggtcacatccagttcactccagtaatccatgcccgcacgcttgattgctttctcatccagatggaatcccagcggttcgatcaggtgcagtcttgtccctgtcgccacgcacgttctgccgatatttccggtgtttgccggaatctccggctcatataatacaacattcagctttgccatgtcagtctccattcgggaggaaacgccctcctccctttttcttatgatctcttgcgaagatctgtgataaacgcctccatgcggttcatcgccttcttcaggttatccagcgagtaagcataggaaatgcgcacaaatccctctccgcagtctccgaacgcagtgcccgggacaacggctaatttctgctgattgagcagctccgtcgcaaattcttcggacgtcattccgaactccttgatgcacgggaacacgtaaaatgcgccaaacggctcaaaacaggacaatcccatctctttaaaccggtgcagcagatagcggcgtctgccgttatactcctcgcgcatggcagccacatcctcatctccgttgcgcagtgcctccacgcccgcatactggctggtggacggcgcacacataatcgcgaactgatgaatctttaacatctgctcgatgatgatgcgcggtccgcacgcataccccagacgccagcctgtcatggcatgggatttggagaaaccgttgatcacgatcgtccggtcacgcattccctgcagggaggcaatcgtcacatgccgctccagatacgtcagctccgagtagatctcgtcgctaatgacataaaggtcgtgctctcttacgatgtccgcgatcttttccagatcttttttctccataatggcgccggtcggattattcgggaacggcatcaccagaagcttggtcttcggtgtgatggcagcctccagcgcttccggtgtcagacggaattcattctccgccttcagctcaatgatcaccggaacgcctcctgcaagcacggcgcacggcacgtaggacacgtagctcggctgcgggattaaaacctcatctcccggatcaagcatggcgcgcatcgccgcatcgatcgcctcgctgcctccgatcgtcaccatgatctcatgatccggatcataggacaccccgtaatgccggtccagataatggtcgatctccacttttaattccttgagtccggcattggatgtatagtgtgtctttcctttttccagggaataaataccctcgtcgcggatatgccacggggtatcaaaatccggctcgccgacacccagagagatcgcgtccttcatctcatggacgacgtcaaagaactttcggataccagacggctggatcgttgtgattgtcttatttaacggatctctcatcttacatctctatcctttcatctttgggctgctctgccattacggttccatgatccttatacttcttcaggatgaagttggtcttcgtgctgagcacggaatccagcggggaaagcttatcagacacgaactgcgaaacctcgcgcagggtctttccctcgatcgtcaccataaaatcaaagcctccggagatgaggtaaacggaattgacctccggatagttgtagatccgctctgccaccttgtcaaagcccatgccgcgctgcggtgtcacacggacctcgattaacgcggtcaccttctcaatgcccgctttatcccagtcgatcagtgtgtggtagccgcagataatgtgctcctcttccattttctcaagctcattcataaccgttgtctcatcgacaccgagcacaatggcaagctcctttaagtcaatccggctgttcttctctataaatgtcaaaatcttttcacgcatcgcttcttctcctttatatcgccttatataattcgtccgccttcggaggctccaaaaatctgcgctcctcctcgttcaaaaggacgcggtcgttccccgcggttgcctttccgataatcgttgcagggattcctgccttctccagttctcttaccagcagattgccatcctctgccgccatcagcatacagccgctggaaatcagctggtaggggttgattccgaaaaattcacagacctcaatggtctcctgacggaccggtatctttttcaaatcgatttcaagtccgacgccagatgcttccgccatttcccagagcgcaccgaatattccgccctctgtgacgtcatgcattgcactaacgccagacttgacggcgactgcggcctctgattgtaccgatatataagcatccagtgcttttgccttctcgacaaaaggcaccgagaactttgtctttagttctgtctctttttcctttgcgataatggaagttccctcaattccgatccactttgtgacaagaatatccatacccggtctcgcccctccggtcgagatcagacagccatccttcactttgccgacaccgcagacggagatcaccggctgattgaccaccgccgtcacttccgtgtgtccccccatcacctggatctttgccttggcgcaggcttcctccacttgtgccatcatggcacgcagttcgggctcctccacgctctccggcagcagcaccgtgagcagcacgcccaccggctccgcccccgcgcttgccagatcattcactgtaatctgaatcgcaagtgtcccgatgtccttcgccgttccggtaatcggatctgtggacatcacaagcgtctcatcctctgccagcttgatcgcggcgcagtcctctccgacgccggctcctaagacaacctcggggcgtctggtatgtatttgtttgaatacggagcgcttcagtacgctctccggcagttttccgatcttcatctgtgttctcccgtttatttacagcttaaggctgtctcttctgaggcagccttaaacaatctcttatacttttattctccgcctgtgatctggctctcatccaccgttccggtaatcgcctgctcttcctgcgacggctgttctaccggtgccggatttaagattgctgccgcactcgccgcataaggtgcaaccgccgcattgatggttgcctcatccccggtcgcaagcgccgcgccaatcaccgcagacacattcgggtctgctgatgccgttcccacgtttacaatcttcggagacgccttgtaggtactcttattaaaaatctcccggctctcctccacaccgtctaccgtgacaactttccaaagtcttgccacatagccgatatgcttgccctgcgcagtcttcatataacccgccggatctccggtcgccacatactgtgtgcccggatcctgctcggataccacttcactctcataggtcacaacccggttcgacggtctcgtgtcatgtccgtagatcttaaaggtgacattctttccctcagtgtatccctcaatataaatcggaatgtcctgattattgacaaaacgcagatccttgtaatcgcctgcaatcgctgcgtccatggatggcttcacatagcttacgatcatggaatgattcgagcgctgcgtgatctcaagctctgccagaatgaccgcattgtacaatgtcgtagatacctggcacacaccgccgccgtaggactcgaccgtctgaccgttctcataagctcctgccagttcgtatccgtttgccgcatccagcggtccgatcgcttcatagacggaaaattcctcgcccggataaagcagtgtaccattgatcttgctggttgcattggagatgttgtcgcagcggttctgaccggaatccttgtaattcgtcgtatagcttcccatcatatccgtgatctgctccagatcttcctcgctgccgcgcggctccaccacttccgccacgagctcgatctcggcgttgccaccgtcccactcactgctgatatagttctcgatcgccgcaatggaatcctccacgttgacctcgatgccctgctcgcccttaatgatcttaaacgcaccgttctcacgaaccagaccattatccacagcctcctggttcagctgcgccgctttctcggaaaggatggatgccaccgcatcggaatccacatccagtgagagtgcaatcactttgtccccctgctgcagatccttcttgtccttgtaccgcttgatgaggttgccgcttctgccgacatctatcgcctcgtccaccacgtttaaattggaaaaagatattcccagatcagccgccgtcacggaaacgctcttatcgccggtcttcaatgtcatctccgccgaatctgcgctctccacgtacgcttctaccgcgctgaccgcttcttcctccgtcatgccgcccacataaatattgccaatatagacaccgtcctcaatcgtctccgtcccctgtgctctcatggaaaccggtgccgccagcaatgcacaaagtgccaccgcacctccaaacaatgtcaaaaaacctgttccctttttcatattcttccctctgaaatatctgttctctgctctgctaacgcctgttttgccaagcatatactctgcttccgctcattatagcccatacgcgcctttcttttcaaggtgcataaacacgaatatgtttgactcactctgagatttttagtatattttacatgaaagcaaaacggcggaatgcgcttataataacgctgcaagcaccgttgtcagaagcatggctgccacaaccacaatgatgattcctgcaagcagttttttattcttttttttaccaaaatcgtacatttcgttctaccacctttccgttcacgccctgtataccgcgcgaaccttttacactataccacaagaagggatgattctcatgatttttttaggactttttatcttttttgtatgtatgttcgcttatctgcgccataaaagcaccgctgccgaagaagccgcagccgagagcttctggaaccgcgagaacgaagcaaaccacacacgccgcaaggacatcagcggacttccctatattaccatacctcttgccgattttccaatgggtatctatgacaatcccgaattaaaaaaatatgaggagactctccaatcgcttgccggacagaaaatcttaaacctcggcggcaagaccaacaccgatctcaaactggagtacggcgttgccaatctggaaacgctctccgcctgtgacgagaactacaccaccctctgccgcaccatctatgagtacgccgaatgtttgaaaaagctcggtcatgacgcggaggcagtccgggttctcgagtacggcatcagctgcgggtccgatcacagcggaaactaccggatgctcgcagactattatctaaacgccagggattccgccgcactcgaccgtcttctcgcctctgccagagcactggaatcccccagacagagtgccatcgtagcactgctcgaggaaaaagtaaatgcttaatcccggggcatccgcccgtgcacggcgatccagcggtcaagcagtctcgacgcctcactccgcgtcatctgctccgggatctccgtctccgggatgccgtaatgcgcagcatatttcttgagaccatccatctgacgccccgttgcgggcgtctgtttttttgtgcggtaacagagcgcatacggcagaaacgcctccggctgtaccgtaccgtactcctgttttaatctctccagcacgattccggtcgccatcgcatcatcgagtgcacggtgcgccctcgcacgcccgattccgaaataggtacacaggctttccagatcctttttctgctccgccgggagaaagcgccttgccagctttaaggtatccacggcatttcgctcaaatgtctgcctgtggttgaccgcccactgtttcagaaaactgtaatcaaaaatcacattctgaccgaccagcacatcgtcccccagaaatgtaaaaaattcctgcatcgcctcttccggttccctgccgtctgccgccatctccggcgtgatgcccgtcagttctaccacacgctctgacagttcccgcccgcactttaaaatagcgccatacgtttccgtctgtctgccgtctctgacgcgcacggctcccacttccagaatggcatccgtcttcgcattcaatcccgtcatctcaagatcaatgaccacataatcctctaacaatctattctcccctctttccggttattccccggaatactccagatattcatgctgcgcctgatgatcgagcggatctcttctggtatagtcaaatctcacatagaccggatcttccagcctctccgggagcgatgcggtatcctgtctgtgaccggaaaaccggtagaaaaaccgctcaatgtgcgactgctttccatttttaccatactgacgcgtcatctgtttccattcattcgcatctgctgcccacgcgggtctgcttccgagattctctctttcatacaggtcatataccagaccctctccaagcactgggagcacccccggcctacgctcttttgcaaattccagcaggatctccgccctgcgcatcctggaatgacccattccaaaataaccgtgctcctcataaaaagttcccagttccgcaaacatggcaaacgcactcgcatactgcgtctccagaagccggattgctgtggcgtactgtccgctgttgtaatacacctcgagcatctcttccacctgccggatgcgaaggatctccccgaaccccagccagtttgtcttaagcacctcatacggcggtctgctgcggtagatcagaccatactctgtggcatgctcatacatgtaagaaccttttagcacttttaaaaatccaagctgaagctgattgggctttaacgcgtaaatctcatcaaacgaacgcgcaaatgtctcatagccctcatagggcagacctgcgatcagatccagatgctcgtgaatattctctttttcctggatgctccttactaccgctttcaggcggtccagctgcatcgtccggtgaatctcggtgattgtggcgtcgttcgtggactgcacgccgatctccagctggatcagtcccggccgcatctgaccgatcagcgcaatctcctcatccgtcagaagatcggcagatatctcaaaatggaagttggtcacgccattatcatgttcgattaaaaacttccagatctccatggcatgttcatgcctgcagttaaaggtgcggtccacaaacttcacctgcgcgacttcctgctccagaaaaaatgccagttcttttttcacccgctccacatcccggaaccgcagtgtcttttccaccgaggaaagacagtaactgcaccggaacggacaccctctgctcgattcataatagatgatgcggttccggaaatcttcgacgcctccgtagcagaacggaatccggtttaaatccagcggctcgcgcgctccggtttttacaaggctctctccggcacggtacatgattcccttgattcccgaaagattcatcttctccgccatctcaccgatacccgcttttgcgtaactctcgcacagttccagaaaagtctcttctccctcgccgaccatcaccccggtcacctgcggatgctcctttagaaacgcctctgtctcataagacacttccggacctccgacccagatcggcacttcggggcagatcttgtggtactcgtccatcagctgttccacatagtccagattccagatataacaggaaaagcaaagcacatccggctttgccttatagattccttccaatatgtagtctatcgtatggttaatcgtatattccccgatctccacctgcgccccgccggtgccataagcctccgcataggcgcgcagatcatacactgccagatttgagtgaatgtattttgcattcaccgccgtcaacaatactttcatcgtctcacctgattcttgccctctctttttgcgcggtaaagagcagcgtccgccacttcaaaaaatgcgctggcacccgcataagccctgtcgtactccgccacaccgatgctcacggaaaacgaccgctccccctgcggcgttgtaaacattttctgttcaaactcctgccggatctgctccgccatctcttccgcctgtccgactcccgctcccttaaatatgatggcaaactcctcgccgccatagcgggcacagaatcccgccgcgcctttgtgtctggcgcagatgtctgccacttcttttaaaacgacatctccaaacgcatgtccgtaggtatcattgacattcttaaaattatcaatatcgatcaccgcaagcgaaaaacgctcccggttctcctcgtaccttctctggtaatactctaactcctcataaaagctttcatggttgtagagcttggtcagggaatcccgcttggaacgctcatcgttcacgatcgccgaatcgttgaccagttccagcgccaccagcataccgcacaccgttcccacgaagatgctgccctcaataaacggggttgtcagcgggaaataagaactggcaggtataaaatagacacagtccagcacataggctgcaacgagcagcgccgcctgcacaagcgtcatgacctggtctttgtagagcggcgtcagcagcatcggcagcaacagaaccatcggcatcagcgtcacgctcgtatgcacccacgccatcacagccgcgtaggatgtcagcaggaatatggcgcatcccgccatcgcccgtctgctgtatacacgcttctgtctgccggtcagcaggcggtacacaaaaagaagcaacagctgcagcccgctcggccgcacaatgaacagccatccatagcgcagtctgccgcagtctgcagtcggcttaaaaaacagaaacaaaaacagttctgtgattaacaccacgccccagatcttccagcccatcgaaaagaagctcgcgctccactccttccagctttcgccactcagccattcatagctgctgtcatgtctgatcttctccatcttttcccctcattacgaaacgtaatactttcttcctagaatattatactgtatcacaccgattctttcaacgacgagtaaacgcaccccgatcagaaaaaaccagagacagctccccaaccgtctctggttctatttgaaatactctccctctttttagcacatgatgtgtcttacaatcacatcgatgccggcaatccaaagcagaagcgctccgccgacatatgcttttgtcttgtgctgaaatcccagatgataacccgtatacacgccaagcacaacgaatgcaatcgtcatacatacgatgatgatcagcatcagcgcaacgttcgtccccaggaatccgaatgcgatccccgcaagcagcgtatagatgcttgtcaccgcagtcatcctcaggaactttttcacatcaaggctctcctcccggcgctcattgacccattcgttcttgattgccttcgcaatcagacggatgccgagtccgaaaaagatcaccgccgcaatcacaagtcctacaaaattctcatcgtgtgccagctcatttctgtaaaggagaccggacagatagttcccgagcgccagcgcgcaaagctgccatacagcgatcaacgcgcagatgacggacaactgttttttgtccacttttgcgaccaatgcgccctggcactccatcgccgcgaaaatatcaagcgacactcccgctataatcagaacattctctatccagttcatttccgtcctccctcacatgactccttattattatactctcttcttacaatatttccagaacaaatacggatttattgagacaattttcattagtcctctttcaccgcatctgtcttgtagatgaacttaatgcttccgttcacgccgtccgcaatatccgtgtaggtctgatagtcctcaccggcatccagaaccgcctggatacgatccatcagaggctcaatatcaccgtggtaggaatttaagatcttctcaattccctcctcgttgaaggtaacgattccgtctgccagctgatgtgcgccgtccgataactgatccacaccgtcgatcactgcgtcggtaccatcacttaacgcgttgacgccatcgttgagcttctgattgttggaaaccagttctgcacttccgttcttaagctgcgccacaccggatgtcagtgccggtaccgcatctgccagactctgggtaccattagccagtgctctcgctccggttaccagactgtatccgcccgagctctgctgctcaatacttgccgccatcgtggactttgtctgttctgccgctgacacggctgccgttccggccgctgctttcgctccggttactgctgcctccccggctgcgatcttcgctccggttaccgccgcttccccggccgcctccttcgctccggttaccgctgcctctccggctgccagcttcgctccggttaccgccgcttccccggctgcgatcttcgctccgcctaaggctgcctctccggctgcttccagtgctgcctgctttgctgcatttgcaacgccctgtgccagggtatctaccgctccgcccatcgcagttgtgattgtatttccaaactgcgctgcaatctgctgctgtgcggctgcgatctcagctgcatgatttgtctgaatctctgctgccgtctctgtcggatactgcgccgcgatcgttgcaaacgccgctccgttaatcagggtctgcacatccgcggaagatgtcagggcgcccgtcatgctgctcatattcgcgccgatctcctgcgccgcctgattcttgacctcatcatacttgccattatcaaactttgcggttacctgctgtgtcgcctgattcttaatcgcttccgcctgaccgtccactactgcctctgcctgtgtcttaatcgcttctgcctgcgcatctaccactgcagatgcctgactcctgatcgcttctgcctgtgcatctaccgtggaagatgcctgatttttaatcgcttctgcctgcgcatctaccgcagcggatgcccggttcttgatcgcctctgcctgtgcatccactgcggacgatgcctgtgtctgcatcgctgccttctcctgatcggtgaaggaagtctttaaagtattgtctaacagttctacgccgtccgcaatcgttgccgcactgctgttcaatgtgccgacaccgttagataatgtcggaatgctgtcggaaagctgcgtgataccgcttgcgatttttcccgctccgtccgtgtatgcatgaacgccggactgcagggtgccaacgccgtccttaaagtcgcccatcttggacttcaaggtgtctacgccgtctgccagttctgcggaaccgtcggtcagctgatccatcgcgtctgcgagagtatcaaatacctcatccagcttcgaggtgtcattgtcactgtcggcgctgatgaagttcgttgcattcataaccaccgtcatcgtggtatcaagcttgaagttctcaacctttgcctttacctcaacgtaatccggaatggtgacatccccgtcgaaatcgtcatcctttacgttcaggctttccttcagtcccggaagtgcatagccaaccacgacattgttgcttccgtcggagatcaccttaccgttttccacctcgatatccgagaattcatctccgaggatcatgccgctgactgccataaacggtacatagatgtcttcgtcttttccgtcaatcttcgctgtcactttctggttgttcgtgtagtcgaaccggatcgtaacctcaccggattttccggcaagctcctccggtgtcacttccttgccgtccagatagtaggtcagcttctgtgtcaccggcagctcgctctctgacgttccctggtagaaaatgtcattgccgtctgcctgccatgtcactttattgccgctttgtgtaaaggtctcatcgccttttacattttcaatatcttttaatgtggacgcatcttccagcgtatccttgtcatcgttgttgatcagatgatcggagacaatgattttctgctccttgccggtattgtcggcgatgacatatactgtctcttcttttccgatctctttctcgcttactttgcttccgttatccagcagatcctttaagctgctctcggcatcttccgtatcttccgcctcctcagaaacttccgtctcctccacggtctctgtggcagcgctgcctgcctttgccgcattcacactgtagacggaggaacctgttgcaacaagcgtaacgaccaggactccggcaataatgcggattgcatatctatttttgaattttgattttaactctggtaatttcatggtttttaccttcctttcccgttactgtaccgatacattgttttccgacacattcaccgtcgtgccctttttattgcgaaatcccatgctcgtcgcacagatcagtttatcaaaaatcataaacatggacggcagaatgaaaataacgacaaacatactgatgattgctccgcgtgccatcagaatacacagggaactgatcatatcaatattggaatacatgccgacaccgaaggtcgctgcaaagaagctgagcgcactgacaatgatcgactggatggagctgcggagtgccgtcgcaatcgcttccttcttgtccgccccgttgtagcgaagcttcttgtactttgttgtcatgagaatcgcataatcgaccgtcgcgccgagctgaatcgtaccgatgacgatagaagcgataaacggcagcgtcgtgtgcgtatatgccggaatacccatgttgataaaaatggcgaactcaatgaccgccaccagaatgaccggcagtgacactgacttaaataccagtgcgataatcacgaaaattgcaccgatcgacacgatgctgactgtcttaaagtcctgatctgtgatctcaatcagatccttcgtacacggtgcctcaccgattaacatggcagaggaatcatattttttgatgatattgttgatctcctcgcactgcgcgttcacttcatcagaagcaaccgcatattccgagccgaccaccatcatctgataatcgccgttgatcaagacgtcttttacgtcatccgggataaactccctcgggatgcctggtcctaccagcgagtcaaagccaagcgccatcttcacgccatccaccttgctgatctcatccaacattgcgctggcatcttttgcggagagactgctgtccgcaatgatcatgtgcgtcgcacccatctcaaagtcttcgtttaacttatcgttcgcagtaatactgcttaagctcttcggcagtgttcccgcaagatcgtaatacacatccgtgtgtgtgtagccgtagattgccgggcccaacaccaccagaaatacgatcaggaatacgccgtaatggcgcacgatccagtctgcaatccgtcccagatccgggatgataaccttgtgcttcgtcttctcgatcgccttgtcaaatacaagcagcagcgacggcagcaccgtaacgcagcagataacgccgagaacaacaccctttgccatgacaattccaagatccataccaagtgtaaagctcatgaaacacagtgccacgaaaccagccaccgtcgtgatggagcttccgaccaccgatgtgatcgtattagaaatcgcatgcgccatcgcacgttttttatctccctgaaaacgcccctgctgctcttcgtaactgtgccagaggaaaatggaataatccatcgtcacacccagctgtaagaccgccgcgagcgcctgtgtcacataggaaatctctcccttgaaaacattggtacccagattgtatacaatcgccattccgatactgagcaaaaagaaaatcggtgccagagccgaatccatcgtaagtgacaggacaatgactgccagtacaaccgcaatcagcacatagaccggggtctccttgttcgacagattcttgatatctgtaaccactgccgacataccgctgatatagcactgatcttttaccacaccgcgcagttcctcaatcgcatccatcgtctcgtccgcggacatcgatgtatcgtataacactgcgagcaaggtgctgtccttctcatcattattaaagaaatcatagatctcatccggcagcatctccatcggaatgctgatgtccgccagtgaatcgtaccagatcactgattttacgtgaggaacttcctccatctgctcccgcattgcagatatgtccttcgcgtccataccctccactacacaaaacgagaatgctcccgttccaaactcgtcaagcaggagatcctgccccttcatcgtctcaatctcttccggcagatatgtcaggatatcataattcactctcgtgttaaaatatccgattgccgacggtatcaataagaaaatactgagaatcaaaatcggtattcgcagcttgacgaccgcttttccaaatttaatcatggtccctctctcctttccataaaagcattgtataaaaaaaagactgaatatgaaaatattcaatcttttctccgtgtatcgggttattatacactcgacccgaaatgtataactatctatacatttatattcatttgtattctgtccgcaattacagttctgtcagaatatccgtcatcgaccgcttgatcatgtaattatagatttctgcaagttccttggatgaaatcgtcattccggacttgatccaggtgatcaccacatagcacatggactgtgcataatactccgcgatacgctctggtgtcagccacacgtaccggctttttctgccctctgcctgtcctttgatgacctgtagcagcacgcgctccacacagctttgtgcaatgctgccgaatgaattctgtccttccagccggcttgccttcgtgtagaactccttctcacgctcgatcccgctgaacagaagcaccagcgcctcgttgatcatcccgttctggatcagcggttccaccggttccagcagttccttgtcgataatccactccagcagatcatatttgtcctgaaaatgattgtaaaatgtcgggcggatcacgcccgccttatctgtaatctctttgattgtaatcttctctatcggctgctttaacgccagttccttaaagctctctgccaaaagtgtatcaatcgcactctttccctgtccagtcataactccctctcgccccaggtgctctatcgcactatgagtctcccaacagttaccgccctcgctttttcatcgtcacgcatgttcaacatctctcccgtctccacaacgcgcaccagcggacgcagcgggaaattctcaaaattccgtgccaccaccgcatgctgcccgttggacagttcgacttcgcagccgatcggatacgccgccactttccttgcgaacacagccacaatatccgggtcaaaccagcggtcgcccagcgccatcacatattctaacgcctccgacggcgacagtgatttctgtgccggaaacgcggaaacctttgcgtcataacagtctgcaatccggataatgcgggcaaacaggtgaatctcgccgccctttttgccaagcggatacccttcgccgttgtagcactcgtgatgctccatgattccctcatacacatccgcggaaaatcggcatgtctcgcgcagatattccgcaccgatcttcggatggctccgatagacctcctgctctttttcgctgcggtgcgccttacctccccgcacgatgtcatgatcgataaaccgcttcccaatgtcatgcagcagcgccgccgctgcaagctggcacagctcatcatgcggaagccccagccgtgcgccgactaccacagaaaggatgcccacatgaatggaatggtaatagatataatcatcataactcttgatgtccatgatattgcacatgatgtctccattgcatatcacatcatcgaccacagactccaccgttttgcgtagcttaaactccgcttccgacggttcctgcttccgcatatccgtgtgaaacagatcatatacaattttcagtgcctgcctccggacttccgggctgacaatctgctgtatctcaatccccctggaaaactcatcgtccacgtagacacccgggaacccaaggaattccagatttgaaatttgttcttctgtcagcagaatatgccttcccagaagaagtcttcccgccccgtcataaatgtcctgccccagtgccattcccggcgtcagtctgctcgtcggtaaataacgcatttgtgcttcctttccgctaaattattattattttagcgcttttactcatcaaattcaaccgtaacaaaatatcccttcggggtctctttgacgtctaccactgtgccttcccgcgacttgatgcgctggcttaccacatagttcgccgacatcgcgtacgccttgcccagtgtatagtaataggaattgggcagcttcccctctgtaatcggaagcacatcgccgacctcaagcagtccggtgcgctccattttaaactcttctctccgcatgaaaatatccctgtttctatggcttttctatgtgttttccactattgccatgcatttttcattatagtataataattctgaattctcaagatgttttcatttaccatatacaaaggagccttatgagcgatcaaactgttctcatcgatcaattcctgtcatccgtcatcggcacgattcacccggacgaaatctttgattctattatagacacagccgtccgtctgctgtctccggacggtctgctactcacgatccgtgacgatgtcagtccttcctaccacgtcacgcgcagttttggcgatatctcctgggaaaaagattcttttctcgattcgagcattcttttagagcagctgttaaacgccgacagctacattccgtttatgccgggcgcaggtctgccgaccgcgcttgacggcgtttccagccatacacgcagctggctgatccggcagaatatcatcggtgtctattgtctgaagtacaaccgggcactgatcggctttctcttcatcgcgctgcacaatcacatgccactgtctgcagatcaggtgtccgcactgtgcaagatcggcttttatgccacccacgcactgcgcaacgcgaatctctacatgaacgcctaccgggcctccatcacggatgatctgacggcgctctacaaccgcaagcatgcgtttgagatgattgatgagctctgcctctccggtacgccgtgctctttaatcatgctcgatatcgatgatttcaagctttacaacgaactttacggctccaaagagggcgatcacttaatccagcgctgtgccaagatcattctctctgctctggatgcggacgacatggcattccgtttcggtgtagacgaatttctcatcttaaaacgcggcagtgatgccgcagccgccaaagcgtttacccagtctctcgtggaagttctgacaaaaggcagcatgcccgacatggtgtgggaaattaccatcacctgcggcatctccgtgtttccggatatttctgccgacggcagagagttgatccacaatgtcgagcaggctgtctattttggaaagcttgatgggaaaggccatctcatcgtttaccgcaaaggtcttgagaaccgctcccagaatccggatatccgcaccgcctacgagcgggtggcgccgaccatctatgcgctgaccgccgccatcgacgccaaggataattttacgttcatccattccatgaatgtctcaaaatatgcggtcatgctcgcggaagcgcttcatatgaccgacaatgatatcgaggtggtacgggtcgcaggcatgcttcacgacatcggcaagatcagcatccccgagcacattttaaagaaaaccgaggggctgacgccggaggaatacgcaatcatgaaaacgcatgtggagaattccatcaagatgatccgttaccttccgaacatggattacgtgatccctgcagttgtcgcccaccacgagcgctatgacggaaccggttatccccgcggattaaaaggaacggaaattcccctcatgggacgtatcttaaccattgcagactgctttgacgcgatgacggccagacgcccctacaagcaggaatgctcgatcgactacgcggcaggtgaactaaaaaagaacagcggcacgcagttcgatcccgaactggtgccggtgtttctgtccctcatagaggacggaaagattgcggggtgaaaatccgcaccaggtacacgtctgcctttcagtgataagtaatattataggaagcacacatcgtgggatttcagctggaaatacagctggatattcggttcataaaatgtggcatttctaaccagccggatgtttgcatccacgatgaataaaaaatattccatcgtttatagcagcttaacaggtaataccaaggtgctggctgatgcaatccacggggcattacctcaggatgaatgtgagtatttcggtgtgtccgacacagtgatcccttcttccgaactgctctatcattgacgcaagcaatgttatcgtcggagagtatatgtgtcagggcagaatgccgcagtctgtctgggaacgctacttgaaaatgaaggaagctcctgctcatccggcaaatcttgatgtattgatccagaattttgactgtgcattgtctcaccctgatgccaatgatctggaaaaactgaaagaagccgttatggatccatccttctgataagaccataaaataaggcagccccgcatagctgagtctgccttactctctttatttaacgttgatgccactgacatattgctgcagaaactgtttctttccacatggtcttccaaaataatatccctgcagataatcaaccttcatttctttcattttcagaagccattctttttcctcgatgccttctgcgcatatcctgacgttaatactatgtaccatggggatgatatttttatataattcataatccctgtcactgttcatcgccttggcagtaaaatccctatccattttcacgtaacttggattcatatcacggatacaatgaagattcgaatatcctgttccaaaatcatcgatcacaaagggaatcccgttcttgtccagaattttacgaaatttgcagaacgaaggtgtcatatccataaatccgctttctgtcatttcaacacataagcattccggctgtaatgaatatttttgaattgcatccagaatatcccgctccacattgccttgcaggatctgaacataggatacatttacattcatccggaagtcaggaatatatttctgcatttcacagcacattgctgcagcttcgttcaaaatatatcttccagcgggaatgatcaatccggtctcttccaataatgggataaactccatcggtgaaacaaactcccgcccttcttccgttatcatggaaaaacgcatcagtgcctctgctccaatgatctgttcggactgacagtccacgatcggctggtagtatacttcaaagccatcataatggttcacaatagcattacgaagtgttgctatgattcttccttttcgtaaaaagacctcatagtcatcctggtcaaaaatatagaatccatttttacccatgctttttgcctgtttcaaggcaaattcaaattttttgcggcattcttcggttccctcacaaaatgttgctgcatctataacaccaatagaaatagaaaatatagcttcataattttcggctactatgaaattacgaagtttatctgtaatcttttctttcagtgccacagcgtcttctgcggaggaagcttccagatccacgatcacatactgatccgctaccagatggtaaattctctgcttgtctgaaaggcattccttcatacagccggctacgcttttcaggatataattaccataatcagctcctctggagctattgatcgctccaaaatcatcaattcctacatgcataaaaaatcccttggtaatgggttctttttgtgcacgcaggtaagcaaggaattccggaccgccaagcagtcctgtgacattatcggctcttctcttgttgccggtctcattcagacacccgaccagatactctgcctttccctgctgatcaatgatcacgataccacggcagttaatccagaccggcataccttctttatcaagccacctgtaatgaagattatgtaccttttctcttccttcgcatatatccgcaagatgctttgcaagcatcctgcggtcatcctcatatactaccttcataacttcatttgcagcatctgtcagaacactttccgacatattaaaccgattcacagctgactgtgaaatctcaaaggtattatcctgcagatcaaatatatacagataatcatccatacattccgtaacgatctcaaataagatttctgctgtctgctctccaaacactttaaatatatcattaatcacaacaagaaccttccttacgacagcttcactctattcctgccatttttctagaatagcttaaagatattcacgcggtcatgcatcttggctgctccctctgccagattaatactgatcgcagtattctcttcggaggatgcagcattgccctgtactacgccggacagctgttcaattccctgaccgatctgctccaaggactctgcctgggagttggctttctccatggtgttctctgcaagctctgcaaaggacttcatatcttcaatgatctgattgaatgattctgctgttgttcttgtaatcgtattgcccttttcgatttccactaaggtcttatcgatcaactctctcgtatttacagcggattttgcactgtctgctgccagcttgccgatctgatctgcaaccaccgcaaaacctcttccagcttctcctgctctggcagcttcaatggaagcattcagggataacaggttggtctgggatgcaatatcctcgatatctgtgataatattaccgatctccttggagatttctgtaatgtactccatttccgtgagcagctcattcattttttctttttcttcgttcgctttatttgcagaggcttttacacgtgcagatgcgctctgtgtttccttcgctgtatcttctgccagatccacgaccgcatcaatggtggcattcaattcctcgatgactcctgcctgctctgttgcaccgtccgccagggattttgatgcattttccacctcggatgaattcgatgatacctgttctgccagattgctgatctcggtcaaggtactgttaaaccgtttcagaatatacagcagtgatgtcttcaattccgagaaatcgcctaggaaatctgtaatatcatcaccatttctggtcaggtcaccctgcgctattgcctttacctccacagagatctcgctgacataatctgccagaatacccatggcttctttcagattcctgatggtatcgccaaactcatcctcagactcataggtaagcatttctacattagacagttcgcccttacgcaggctggcaactgctgcctctatctgttctaccggctctgtaatggaattggtaatgatccttccgatcagtgtcgtcactacagcaatcgcaagacccgctgccacgatcacaataaatatgattacagtgcatacattagccatggtctttgcctgatctaattctacctggaacttttcacataatgtagttaatttctcagcaaaagccttatattcttcatacacctctccggtcatcagcttcgatgcttcctgctgtttaccttcacggctcaactgcagaatttcatctgaagcagccctgtatttttcccatgcagcgtttgctacatcataatcatcccgtcctttttgagctttgctgtctgcagaaattattgcatccagcttcgcaccggtatcctcgatctgactctccagcttctggatttcttcttcgcaggagttcatgactgctgcatctgattctactagatgctgatactgtttgattctgtatttcgcagtcattgtctctaaatcctgcagatattccaatgacggagaccagacctccgtgatcttctctatatttaaacggatcactaatgtcgagatcagtgccaccaatactaaaaataatgtcataacaagcactgtcattcgatatacttttaattttcctgcaacctttaagttagttatacgctttttgatcttttccatgatagttttcccttcctttgtaaattattgttctttttatcacgtatatctatccatatatcgtactaagatagcatactttattgggaaaatctattactaaagtattaaattactcaaacttcgcacattaaaatgtgcctatgcaccttgaaaattcaataataactggcataaaaatagcatgaaaccaatggttttggtataattgagttgccaaaaaaacaattacaaaccggagactcatgctatgaataaaagtataacacaagcgcctcaaaatgataagcagatttctaaatctatcaaacgattttttacaaggtttcatatttcctcagccttgaaagctgccaatgcctataaaaggaaaggcactccggtaacggagatttttcaatacatgtttctgctgattttctccaacagaagtatgtatatgagtctgcttacaggaaaaaacacacctaattttgcaaaagctaccttaacttgagcagagaatgtaattctctgtcctatgatgcaatgactgcgcataccgcagttgttttcacccgatatatgatgctgtcactggaaagccgggaatccaatgataaccggtcacttggggagctctttttatacttttctgacgaaatgtctgatatcacatggatacaggcttttcaaatgctgcttcaaatgttcagaacaatgctttcagataacactgaactttcagacgaaaaaatcaatgaattggcgaatgcatttatggatgcacttcctactatgatgaaaatacgactgcaggctgcataaaggctgaacactgacaactaaataactgccagatattgaattttcaaggtgcatagctaaaatttatgtgcgaagtttgagttttataattaaaaaagagaatgaaggaaaaagtaggaaacaagccaaaatagccggtttaaataagtttttgcaaatctattatgcaagagtgatggaaatatataagaatatagcatagttgcataagaaaaaagcctgaataatcaggcctatttcttatgcaaaaaaaattaaaaattgtgttgacatctcttaacaaatctaaaaagtccgcccattgtctccggtgtgccggacatgcacccgttggattgtccaaacgtggaagagacgctatcttatatctctttatagtctacatccacggcttccgcttcctgcttcatcatctttgccgcatgcacggcgcggtttgccacccacagatccgagataccgtcatagatcagggcaattccgataaactgcagtgccagctttaccatgccgaacgcattcacgatacagagcacaccgaacaccaggctgaccgctgcaatgattaacatgctccaccatttctcataaccgttgcgcttcgtttctatcgcaagcttcagatcctggattccatgtacgcagaggatcacgccgatcacaatcgggatcaggctcacaatgctctccgggcgcaggaaaatccagattccgattaacaatacaatcagtcccaatgctcccgcaaacggatgaatactgcggttcataaaataggatgcgatgtcgacgcctcccataatgatcaatccaacggcaaggattttgcagaatacatcgatcgtctcagccggccataccagaagcacaatgccaagtgcaatgcaaagcagcgccgagactatgatgtctgccttgatccgctttaatgtttctttcatatcacatacctctctgtcactttttctgcattatactctattcaatccacagtttcaagaaacaatgcggcggctttgtctattcccattcagcccgatctgtcccgcttgactttttttcacaattccactagactatgggcacaatgaatcatatgtcccgccgcagtgcaatccacgcggagcgtttttccttcacaggacatattttccggaaagaaacaaaggagtgaatattttatgggaaaagaagtaaagacgaatgcgatgcgcattcttgataaaaataagattccgtacgaaattttaaattatgagtgtggagaatttatcgacgggctgcacaccgccgaggcgaccggcgctccggtggaacagtccttcaagactctggtgatgcagggaaaaagcaggcaatactatgtgttcgtcatccccattgcggacgaggtggacttaaaagccgccgccagagccgtcggcgaaaaatccgtggagatgattcacgtcaaagacatcactgccatcacgggttatgtccgcggcggctgctctcctctgggcatgaaaaagcagttcccgaccatcgtgcacgagagcgctgcggcttttgacaagatctacatcagcggcggacgcatcggcacctccatcacggtcaatccggattccctgcttaccgtggtgcgcggccagtatgccgacgtcatccggcatgagtaagttcttcttccatctcctctaagatgtggagcagatcacgtatctgccttggatttcacttctacggtcttctgtgcaatatcagtcgttcccttggcaccttcgttcgttgccgttgcaattccctccatcgcatccagcacgccatcaatcgatgccagaagctcctcggatgtcgcgctgaaatcgctgatcagtgcatcgatctttccggcatcctggttataagcgtctgccacctcatcaaacgtatcatagctcgccaccacatcatttccaacaaaggcaagcagctgctccgcatcagaagaaagctgtgccacagaagatgtaacttcctccgtcaccttctgtatctgggcaacctgaaaagatctgctcagtgaaaacgccatatacagacagaccgccatgacaatcacaatcagcagactgcccgttccgataatcgcgatcagtgccgtttttacattctcccgcattgcctgcgtttctttctcaacagtctcatcgatatagtcaatatagtttcccgttccgacaacccagccaaacggctcaaatgccctgctgtaggatctcttcggagaagattccgtctcaccttctttcgggaatacataatccgtatatccgccgtccggttcctgcccgacgcggataatctcttttaccatctggtaaccatccgcatccttcgtctccatgcggttcgtcccttccgtcgcgcttccaagcagaaccacattctctccatcataggtatctgcccagaagtatccgccgtccccgtacctgagttcccgcagcagatctgcaccgcgtgtttccgcttcctcataggaataatcaccattctcatagcctgcatacaccgcatccagcatggaaatcgcattatctacctgattcttaatattctcatcgtaatcttcttcgatacttgcgcggagaacactctctgaacccctctccataatcagaatccggtttactgacagaattccgatcgccagtgttccgatcagtgtgatcagtgccagaataatcatcttctaacgtacactcacatttttcatacctatccgactccttcctgtgcttacttcttttattatcgtatattccccactaatcgtctatatttgttaataatttagcaatctattcatgttttttgtcaatattgcatatatgtaaaaacgcaggactcctcttttacaatcacagaagtctgtctaaagacattcacccgcaacgcagttacactaaagccacaaacggtgagcggcacatcagaccgccactcatacaaccagaggggaaccgggtggggccggtttccacactaagaaaatggagggactttacatggcaaagtacatcatggcactcgatgccggaaccaccagcaaccgctgcatacttttcaatgagaagggtgaaatgtgcagcgttgcccagaaagaatttacacagtatttcccgaagccgggctgggtagagcacgacgcggaggagatctggtccacacagcttgaagttgccaaggaggcaatggcaaatgtgggcgcgactgcagccgatatcggggcaatcggaattaccaatcagcgcgagaccaccatcgtatgggataagaacaccggcgaaccgattcatcacgcgatcgtatggcagtgccgccgtacttccgaatactgcgattccttaaaagccaagggactggttgataccttccgccagaagacaggactggtgatcgacgcctacttctccggaacgaaattaaaatggctgctcgacaacgttgaaggcgccagagagagagccgagagaggcgagctgctcttcggaaccgtggagacatggctgatctggaaactgacacagggtcaggttcacgtaactgattactccaacgcttccagaaccttgatgttcaacatcaataccctggagtgggatgaagatattttaaaagaactgaatattccaaaatgtatgctgccggaaccgaagccatccagctgcgtgtacggcgaagcaaacccggtattcttcggaggcccgattccgattgccggtgctgccggtgaccaacaggccgctctgttcggtcagacctgttttaccgccggtgaggcaaaaaatacttacggaaccggctgtttcttacttatgaacaccggcgaaaaacctgtattctccaagaacggactggttaccacgatcgcatggggtctcgacggaaaagtaaactacgcactcgagggttccatcttcgttgcaggtgcctccatccagtggcttcgcgatgagatgcgcttcatcgattcctctccggattccgaatacatggcaagaaaagtcaaagacaccaacggctgctacgtcgtgcctgctttcaccggtcttggtgccccgtactgggatcaatacgcacgtggaactatcgtaggcattacccgcggtgtgaataaataccatattatccgtgcaaccttagagtctctcgcttaccaggttaatgatgtattggctgcaatgaaagcagattccggtattgatcttgcagcattaaaggtagacggcggagcaagcgcaaacaatctgctcatgcagatgcaggcggacatcagcaatgctccggtcaaccgtccgatgtgcgtggagaccacagccatgggtgctgcctatctcgccggactggcagtcggctactgggcaagcaaagaggatgttcttcagaactgggcaatcgaccgcaccttcacaccggagatcaccgacgaggagcgtaacaagaaagtccgcatgtggaagaaagccgttacttattcgttcaactgggcgaaggaagactaacacacaatttcatatctaagagggggtatttattatgacaccatatattgcagagtttgtcggcaccatgatcctcatcctgttaggtgacggtgttgttgccaatgtcaacctgaacaaatccggcatgaaaggtgccggtgcagtccagatcacacttgcctggggtcttgccgtactggttcccgcctttatcttcggcgcggcatccggcgcaagctttaaccctgcattgaccatcgcgcttgctgctgacggcagttttgcatggagcatggtaccgggatatattgtggcacagctggctggtgctttctgcggcgcatgccttgtatatctgctgttcaaagatcagtttgacgcaacggaagacgcgtcaacgaagcgcggcgtgttctgtacggcacctgcagtgcgcaacatcccgcgcaatatcttaagcgaggctgtcggcacttttgtactcgtatttgccatcaagggtctggcacaggttccggatctggcggacggcaccggaaaatttctcgtattcgccattatcgtatctgtcggtatgtctctgggcggtctgaccggatatgcaatcaatccggcaagagatctgggtcctcgtcttgcacatgcagtgcttccgattcagggaaaaggttcctctgatttcggatacggactcgttgttccgatcgtcggaccgatcctcggcgcattggctgccgtgctggtatatggacttattttttaaaactatagattgaatgtcagagaagagagccaggcagaaaacacatcagaaatgatgtatgatctgcatggctcttttaaggaggaaaaactatgtatgatgtagtgatcattggtgccggcgtctctggaagcgcctgtgcacgtgaactttccagatacaatctctccatttgtgttgtggaaaaagaggaggacgtctgctgcggcacttccaaagccaacagcgccatcgtccactccggtatcgactgtaaacccggaaccctgatgtcagagatgaacgtccggggaaatgaactgatggaaccgctctccaaagagctggattttgaattccgcagaaacggttccctgatcgtctgcttctccgaggaggaccgcccgaagctggaagccctctacgagcagggcatttccaacaaaatcccggatatccggatcttagatgcacacgaagttcatgagatggagccgaacctctccgaggaagtcatcgctgccatctactgtccgaccggcggcattgtctgcccgttcggtttgaacattgcactcgcagaaaatgctgccacaaacggcgtcgaattccgttttaacacagaagtgacagacatctgccgcaaggacgacggctatcaactctccaccaaccgcggttacatcctgacccgctgcgtggtaaacgctgccggtgtgtatgcagatgtttttcacaacatggtcagcagcaagaagatccacattaccccgcgccgcggcgaatactgcctgctcgacaaaacaaccggcggtctggtcgacaagaccatcttccagcttccgggcaaatacggcaagggcattcttgtaaccccgacggttcacggcaatacgctgatcggccctaccgcagacgatcacgacgataaggaggcaaccaacaccacccgccagggacttgaccatgtctgcagcgcagcaagacgctccgtgccttccgttccggtccgtcaggtaatcacgtccttcgccggaaaccgcgcccatgaggacaaccatgaattcattattgaagagttggcggatgctccacactttgtcgactgctccggcatcgaatctccgggcctcaccagttccccggcgatcggcgagcgcgtagcgcagattgtatccggactgcttcacgcacagaaaaacccggcatggaacggcagccggaagggcgttctcaatccgaaaacactctccgaggaagattatgcggagcttatccgcgaaaatccagcttacggaaatattatctgccgctgtgagatgattaccgagggagaaatcttagacgccattcaccgtccgcttggcgcacggtcattagacggcgtcaagcgccgtacccgtgcaggcatgggacgctgccaggcaggtttctgctcgccgcgcaccatggaaatcctggcgcgtgagcttggtatctcccagcttgaaatcacgaaaaacggcggctcatccaacatggtcgtcggcctgagcaaagacagaacctgaaggaaaaaggaggattattatgacttcatatgatattgtgatcgtcggcggaggtcccgccggtcttgcggcagccgtttccgccaaaaataacggcatcgaccggatcctgattctcgagcgcgaccgcgaactcggcggcatcttaaatcagtgcatccacaacggtttcggccttcacacctttaaggaggagctgaccggcccggaatatgccagacgctttatcaatcaggctctcgatctgaacatcgaataccgtctgaacacgatggtgatggatatttctctggcagaaggctcttccgataagatcgtgacggctatgaaccgcaccgacgggctgttccacattaacgcaaagaccgtgattcttgccatgggctgccgcgagcgttcccgcggagctttaaatatcccgggctaccgtcctgcaggcatctactctgccggaaccgcgcagcgcctggtgaacatcgagggctttatgccgggacgcaaggttgtgatcctcggctccggagacatcggcctcatcatggcacgccgtatgaccttagagggcgccgaagtcaaagtcgtcgccgagctgatgccttattccggcggtctgaaacgaaacattgtgcagtgtctggacgatttcggtattccgttaaagctgggccatactgtcgttgacatccgcggcaaagagcgcgtggagggaatcacactggcacaggtggatgaacacaacaagccgattcccggcacggaggaagactacgaatgcgacacactgctgctctcctgcggtctgattccggaaaatgagatttcccgctctatgggcgtcgagctaaatccggtcacctccggtccttctgtcaacgaaagccttgagacaaatattccgggcgttttcgcctgcggtaatgttcttcacgttcatgatctcgtggactatgtatccgaggaagccggcgttgccggaaagaacgccgcaaaatatatcaagtgcgggggcgatcatgctgattccggcaaagagatccccatcgtcgcaaccgacggcgtccgctataccgttccaaaaacgctgcatgtcgccaatatggacgacgagctgaccgtgcgtttccgcgtcggcggtgtatacaagaactgttatatttccacctacttaaacgaccagcggattatctgccgcaagcgtcctgtcatggctcccggcgagatggagcaggtaaagctgcagaagtccgttctggaagcaatgagtgacctggatcacattaccatcaaaatagaagaggaggcgtaacacatggaaacaagaaatcttacatgcatcggctgcccgctgggctgtgccatcacagttaccatggatggcggaaatgttgtctccatcaccggaaatacctgcaagcgcggctctgactatgccgcaaaggaagtcacacatccgacgcgcatcgtcacaagcaccgtctgtgtccgcggcggctccatcccgatggtatccgtcaagaccgcacaggatattcccaaagaaaagatcttcgagatcatgaaatatatcaacgcgctgacggtgacggctccggtacacatcggagatgtcctgctgaaagatattgcaggaaccggcgtcgacctgatcgccaccaaagaagttctctcttagaaccgcagatgcagctgcaaaagtaaaaaagtaccggtaagccagaccagcttaccggtactttttaattttgtcagaatagcattacaatactgcggtgcgcgggagcaatacggcaagccccgcgtccgtttttgcaatcgcccgcatcataaactgcacatcccgctttacctgttcccccgataacgtttttctgtaatatacaaaatcaatcatatagtagcagatggatgtggaaagaaagctcgtcaccgcctccagttcctcaggatgcttttcaaacatgcccggattctcgccaagcagcagacggcgcacctgcgcatccaacgccatgcgtacaccacgcacgatcatcggccacgcgagctcgttcgccagcttctcataaaagctgcgctccctctgcagcacctccatcagatcgcatgcccacttttccatactgtcatactgtccctgcagctgatccttaaagtcattacagccgatccactccagcacatcataaatatccttaaaatgataataaaaactctggcggctcatccccgttgcctccatgatgtccccgatcgtaattttggatatctccttgcgcttcatcagctgcctgacacaatccgcaatttttttcttagttgaataacacatacccgtacccccttctcctgatacactgtatccgttacattttccacactgcctggtttgtcgttgaaatcgcaatcgctcccgcatccagtgcccgcatgacgtcctccttctccgagatcagacctcctgcgatcaccggtactgctgcctgccctgctatatgctttatgattttaggcataatgcccggcagcacctcgattagatctgcaaactccataccgtggtgttccagtcctccaatcgccttggaatcaatcgcaaatatgcgaaataccgtacagagatccagctccttcgcataacggatcatttccggctttgtggaaataataccgtccgccgccgtcccataccgtataaaacgcaccgcttcctccctgaccgcaagccccccgatcagatccagatgtacaatgacaaactttccggcatcttttaaccgctgcacaatatccgggatggtaatcaactctccatacaaaatgaataccacgcggatatcattctgtatacagacctccacccccgtctcgtccttcaccgccgcgataatcggtccgtccacaatcgcgtcataaaattgctgcttcatcttttgtctgcactccccccattctcccctgccgcatcatggcattcctggcgcatcatttccataatgatatttcccatagcggaagtcaaaaaatcccgcaagctgcacattctttatttcttcatagggcgtaatttcctatgaaaaaaagcacaccgacagagtaacatttctgttattcccggcctgctctttcactcttggctcacactatagaattgtatgcaaaataccgtgtaatttctttctgacattattataactatgtcaaaaaggaaacgcaaccgaatttcagattttgcatttgacaatttcagcgttttgtcaaaaaactcacatcggattctcaaggtattccgccagcacctgatataaccgctgcggctctaccggctttgcaagatagtcgttcattccggcttccttacaggcatccatatcctcgcgtgcatcttttgcactcatcgcaataatcggaatcatctacgcatccttgtgcgacacccgtcggatctgccttgccgcctcaaagccgtccatcttcggcatcacaatatccatcaggatcgcatcgaaataatgcgcttccttctccataaaaagacgcaccccgattcccgccggacatgcgtctcttattgtatctttatgtatgccttcgtttcgatatgacatatatgccttcgcttcggtatgccttagcttgtcatctctgtgccgtcataacgtgccagatccatgatcttctgaagctccgctccctcaaccggcgcctcgcccagactctcatgcctgccatccggcaggatctgtcccaatgcgcgcacttccttctccgccgtcatctcaatcgtgtagtaacccgctttcttcgtctgcggattaaacgtaatatagatacgatagcaaagcggggctgccagtgctttctccggcagatccacgcggatcagtgtcagatcctccgcaatgtcaagcgccataaccgaatagtctgcctctgtgtacggatagagcttcggctccttatacgtctcggcaaaaatctggttcacgaacgcctcgcgctcctcacagagcttccggacaaacgtctctccctctgcatacaggcgcttcggcagaactccaaactccacctgctttttcacaaacacgttaaactgctgcggtgtcatcttcacctgccgcatctgtgccgccttctgatctgcctcatgcagcttccgtacaagttcggtctttaatacaaggttatccgagaacggattgatgaccagcccggtcagctccagttccggcttcacgacgatgttgttgcacgccgggaacggcatgaaaagaagtgcctggctcttcggctcctccggcatctgctccttggaagtatatgccacaaaaaactgctcgcccttgttgttcttgaggaaacacggggtcggctgatccggcgccttaagcattgccggcacatacagcttggtcggacgaagcaggtttaacaccgtggtaaggttctccttggtgcgctccgccgcatactgcttaatcgcttcctctaatctatcgttggtgatctccattgtcattttctcgtccatcttataagtatcctttcctatgctccgatgtcgctaaaatgaattatatcatatctttcccataaaatgaactgttttctaatccacaacaaagactgagatatcctgtgtcagacgctgtgccgtctgatcgcatctgccaacttcatctgtgaccgtatccgcctcggatttgacttccacggtcttttgtgcaatatctgtcgttccttttgcaccttcgttggttgccgttgcaattccctccatcgcatccagcactccatcgattgatgccagcagttcctccgatgtcgcgctgaaatcgctgatcagtgcatcaatctttcctgcatcctggttgtatgcatcagccaccgcatcgaacatgtcatagcttgccacgacatcatttcccacaaatgcaagcagctgctccgcatcggaagaaagctgtgcgacagaagtcgtaacttcctccgtcaccttctgtatctgggtaacagtctgcttggactgatctgcaagtccgccaatttctgttgccacaacggcaaatcctttgcctgcctccccggcgcgtgctgcttcaatcgaagcatttaacgcaagcaggtttgtctggtttgtaatctccatgatcgccgatgataacacttcgatctgctgaactacctttgcagcctcaagtgcctttgtaaggctctcccgtatctcattgtggatccggctcgcatgctcacgctgttctctggtatcgttctgtgcctttgatgcccgctcgtgtatatctgctgcctgctgtgccccatcctgcgaacgatttgcaatattttttgctgcctcttcaatctcaagagacatgctcttaatcgtatccgaggatgccgcggtctcctccatgcttgcagcaagttcctctgtcgttgcggaaacgtcctcgatattgccgttcagcgtaatcacattcgtcttgaccgtatcgacgacctccccgattacataactctcatttttcacttctctgataagatctctgatctggcacttcatattctcaaggcgctcgccgagaataccaaagtcgtccctgcggttctcaagctgtaccggcagcggctgcgaaaaatcaccctttgtaatataaccgatgtacgtgagtgcaacctgaaatgatttgctcagtgaaaacgccatataaagacagaccgccataacaatcacaaccagaaaacttcccattccgataatcgcaagcagtgcactttttacattctccttcattgcctgtgtctctttggcaacagtctcatcaatataatcgatataattgcccgttccaacaacccatccaaacggctcaaatgccctgctgtaggagcgcttcggagaggactccgtctccccttccttcgggaatacataatctgtataaccgccgtccggctcctgtccgacacgtataatctcttttaccatctggtaaccttccgcatcctttgtctccatacggtttgttccctcggtctcgcttccgagcagaacaacattgtctccgtcataggtatccgcccagaaataaccaccgtctccataccggagttcccttaaaagatccgctccgcgcgtttcggcctcctcataggaatagtcgccgttttcatagcccgcatacaccgcatccagcatggaaattgcattatccacctgattcttgatattctcatcataatcatcttcaatacttgtacggagaacgctctctgatccctcctccataaccagcatccggttcactgccagaactccgatcgccagtgttccaatcagcgtaatcagcgcaagaataatcatcttccaacgcacgctcacatttttcatacccatccgactccttcctgatagttatttcttttattatcctactttttcatttttttgtctatagatgttaattattttgcaatctttccccgttttttgtaaatattgcccatatatcacttacagataacgcgataacacttacggaaccggatgattcttacatatgagtaccgtagaaaagcctgtgttcttctggaacggactgattcccacgtccccgggctgacagcagatgtcttccacatgccagcacccctgcctcttccattgcgaagaagcaggggtgcgctttttgtttctatatgtttttaaaaacagtacctgttacaccgtttttttatcttctgcaactttgaatttgcggatcatttcacgcagactttccgcctcactgctcatctcctggctggcagccgcgcattcctctgatgttgcagaatttgtctgtacgacatcattgatctgctcaattccctcattaatctgcttaatttctgtcgtctgtgtctccaacgtctctgcaatatttgtaacttcagtcgtaattaatttggaattctcagcaacctcttctaattgtgccgcagtctgtcccgcaatcaccattcccttttccacagctttcacagaggtttcaatcagattcgcagattcctttgccgcctgcgcactctgatctgccaatacgtttacctgatttgccacaactgcaaatccctttccagcctctcccgctcttgcagcctcaatggaagcattcagtgccagcagatttgtctgggatgcaatttcgttgattgttgtgataatcttatcaatctcttttgatgcctcgctgatctcatgcatggaatcaaccatttcatgcatcttgccattactttctgaaatggcatttcccagttcatccacttttacactgatttcttttgcagaatgtgaatttttttccacctgttctgaaacacctgtaacagttgctgtaagctcctctactaccgctgcctggtttgtagctccatctgcaagatcattggagcttgatgctacctgctctgctgcgccggagacttcattggaaacattctggattcctttgatcgtacctgccatacttgcctgaaatgccataaacgaatttaaaatactgacaaaatcacctctccactccgcctcaggatgaacatcaaaatttccttctaaaaagagcttcatggagcggtcaatatcatctacataggttcccagtatacgaattgatttccgcatactgtgcgccagtcttccgatctcatcatcggaatgatattccagcgtactatgcagatttccttctgttaattccgttgcaacgtcctcaatcgcatgtaatggctccagaattgtttcaagtactctcttacttgttttccgcgtcaaagtaaatgcacgaatcaggcagacaataatcactacaaatcctgcaaccgtacagactactatatttctgactgtctcgctgcttgcctcatctgtcagttcatctaattttatcgcaatttctactactttatttaaagccggggtacaatcattaagaattgcatctgtggcattctcatcgtttccgttttttatttcttccataatggaataaccaatttctccccagtcagaaagagccgatgaatattcctcgtaattttcatcggaaaggacttccgttttctttaaaatctgcagttcagaatcaacttctgaaagcagtctttttactgtttgttcatagttatcgtaagaggatgtatcctcatttaatgccatctctctgatatttcttgctgcagcattaacgttaatcctgcagatttttactgcctggtctgctgcattaacatcctcaacataatgcatcatattggcaaacaatacccctataattacaacagaaagcagaccagagatcaacatcattgtaatgacttttctatagccatagtctatcctttcctttaaatgcatgttttccaatttcttcttcttcatactctcttgtgatatcatgggattcttattcctttcgcttatttttagtatatccttagtactaatacactaatatatcaacttctttttaaaagtcaatacacgtcatttattttattttatttttattttacatctgaccgtttcggcaatctgtccaaaaactcacatcggattctcaagatattccgcgagcacctggtacagtctctgcggctccaccggctttgcaagatagtcgttcattccggcttccttacaggcatccatatcctcgcgcgcgtccttcgcgctcattgcgataatcggaatcatctgcgcatccttgtgcggcacccgtctgatctgccttgccgcctcaaaaccgtccatcttcggcatcacaatatccatcaggaccgcatcgaaataatgctcttccctctccataaaaagctccagcgcctgccgtccatcttccgcacagacgacttccacgccccggcgctccaaaagcttccgcgtaatctcaacattgagcggatgatcctccgcgagaagcacccgcttccccccgagcgcggcaaacgcctgtctggaacccccgcctctcgccacttccttctgcggctgaatatccacgagcggaagatccagatgcaccttcaccttcgtgccctcgccgatcgcactcgtgactgcaatacttccgccaagctgctgcacaatattctgtgtaattgccagccccagtccgctgccgtgccgccgttccgcctcatcccgtctttcccgcgtaaacggctcaaacagcagttcctgaaactccctgctcatgccgattccggtgtccgcgacaacataatccgcagaaaaagtaccgctgtgaaccgcataattgcatacccgaaaagagatctctcccccttccggagtgaacttgaccgcgttccccagcagattaaaaaagagctgctccagccggatcggatccaccatgacattcagactgttctcgccgccggacatgtgaaatgtgatcccctttttggcacactccggctctgtcatatcccggatcgcctccataaaatcctcgagcgcatacggcttcggatgcagccggaatctccccagttcaatcatggaaacatccacgagatcattcaaaagccccatcagaaaccggctcgccgtatcaatttttccaagacattccaccatcttctccgggtgatccgactcttcaagtccgaccgccgtcattcccatgatcacgttcatcggcgtcttgatgtcattgctgatgcgggagagaaaatccgtccttgcatccgcgacatgctgcaacgcctcatccctctcacgctccgccttccggatcaaaacgatgctgaccgccagtatcgctccgagaagcagcaggaaaatcagcagcaggattccgctttcccccatggtctttttcctccaacaagtatcattccgacaagcagcactaccgccgtcgccacctgatccggtgtcccaaaaacaatgtcacgcacaaaactccacgccgcgtgaaacgctccgattccccatatatttccgcgccggatcagataaagcgccgcgaaaataccgaacagcataccgtttaaaaatgcaagcggcgcctccacggctcccgccgcgtacggaagcgcaccgatcaccgcactgataagcaccgccaccgtcatcgaatagcgccgcgcgatcgttaccatcaggtaactgcggtacaaaagctcctccgccatcccctggatcagatatcccaggagaaacagcaccagcatccccggcgccgttccggtaaacagcttcgcttttcccgccgccaccgcgataccccccgtgactaccgcaaataccaccccaagtcccagtccaatggcatattcccgcagcgcgtgctccttcacaaaaccgatcatctcaaagctgcgcttctggaacttcctgcagaataagacgaccaccagaagcatggcaattccggaaaaaagctttaacaccgcgtaggcatccgaacccgcaatctgcaccgacacctccgacagctgttccatatccccggaggcagccgcatcctgatatgccgtgttcgtattcagcagcacaagctctcccggcagcagaatcagcatctctccaaatgccgcaatgatgtacaccgtcacaaacaccagcaattccaccagccagtgctgccccttctgtacctttttcgactgctcaacgagcttcggacaatctatgctctctttcatctcaatctcccatcctgcgtgtgggcttctgtctgcccgctgcgacatttcattttacggaaaactgcctgtttccgccgtttttctgcacttatcataacataaaaaatggagcgatgcaaaaatttcctgcaccgctccacacgcattttccggctcatttcttccgccggctgacgcttattccggctcacttcttccgccggctgacttccatcccgatccggttactaacgccggattcctatcccagctcgattaccgccacttcacagcttccgagtgtcagcgcgttcgctttttcacatgccgtctccaccgcgctctctgctctcagattcgacagcagtacctgcctgcacggataggcaagcgtcagggaaaccgcatccgttccaaagtttgctgcaaccagtatgcgctgcccactctccccggacacacggtaatacgcaaatacatccgccatttcctggtaagccggctcgaagataccgtaggtgaatgtttcccggtaggcgtccgccttgcgcagatgcaccagtctccggtaataggcaagcaccgaatccgtccgcgcctcctgctccctgacattgatctgccggtaattcggattcattgccagccacggcgttccgtccgtaaatccggcattctcatcatccgtccactgcatcggcgttctggcattgtccctgctgttctcgtagcagcagcgcagtgcctcctccctgctgcagcccgcgtcaatggcaacctgatactgatccttcgtgctgatgtcgtcatactccgaaatgtcgttccggatgcaatttgtcatgccgatctcctgtccctgatagataaacgggatgccgcggagcagaatggatgtggttcccagcatctttttcccggcttcatttcttgcatgctccggcagatagcggctcgctccgcgcggctcgtcgtgattctcaataatgttcgccgcgaatcccgccttctgcaattttaactgggatgcaaacagcgtatcgcgccattttttgaattcgattggtttgctgtcataccagccgtgttctccgtaggtcagctcatgtgcggaaaaatcaaacatggtggaaaaatgcccgtcatccccgatgaactccggcagttcgtcctccttcatgttaaaaacttccgccacggtaaatgcatcccatttttcaaaggttgcatgttttaagtcctctaaaagcgcgccgactccctgcacttcctcaaccatcttcacacaggaggcaagtccgtcgtctccatccggcgggaatgacggaaatgccgtgtcttttttgatgttgatgattgcatcgatgcggaatccggcaagtcccttcgccagccaccagttcaccatatcgtagatcttctgacgaaggacaggattttcccagtttaaatccggctgctcttttgcgaacatgtgcaggtaatatttgtctgttcccggcaccggctcccacgcatttccgccaaaatacgagcggtaattgctcggctccctgccgtcttttcccttcacaaagtagaagtaatccgcatattccccatccggatctgccagcgcctttttgaaccattcatgctggtcggaacagtgattcaccaccagatccatcacaatgtacatgcctctcttttttgcctcggcaagcagctcgtcaaactcctccatcgttccgaattcctgcgcgatcgcgtagtagtcggaaatgtcatacccctgatccacaaagggagatttataaatcggagagagccagatgatgtcaatgccaagctctttcaaatagtccagcttcgagataattccccgcagatccccgattccgtccccgttcgtatccagaaagctcttcggataaatctgatatgccactttatcgtgccaccattttttcttcattgcacattctcctttttcccaatacggtttttcttttcctttttgtatgatactgttattataataagagaaatccgtaatatcttgcactatattttcttttttattgcacaatactgctatttaatatcaggggaacgcacatgaataggacatccattccggcgccggagcaaaaggaacacgcccggcacggtgaacagctttttccactgcaaaaatatatcaccacgctggacgatctgcacccgtccgtcagcgcacactggcacgaggaagcggaatttacgcgcattctctccgggagcggcacctatcagatccagctgcagcactatgacgttgccgcgggcgatctcctcttcatccctccggcgctactgcacgcaatcaccgtgacgcccagagagaagctttgcaccgagacttatgtttttcacatgcattttctcggcgccagcaccgcggacatctgctccgtgcagtatctgacgccgcttgcgacagcaaagctgattccgccgtttttctttgatacccgtcatccgctgcacgctgccttagatgacctgttcaacgatatggatgccctgcacgacgccgccacgccgggctatgagctgctgctgaaggctgattttctgcgcctgattgcgctgcttctcccctgctgcagcgcagcggatgaggacacacggctccacatggaatataccgccaaattaaaaacagttctggagtatattgatgcccattatgcggaggagctttccatctccgctctggcttccctgtgctatttcagtgagtatcatttcatgcgttttttcaagcgcttcatgggtacctcctgcttaaattacatcaagaacctgcgtctggagaaggctgccgagctgctcgggcaggacaggcttaccccgctggacgtctccctgtccgccggcttccacaacctgtcctacttctaccgggaattccggaaaaaatacggcgtgaccccgggggatttccgcggagccggtgcccgggagaaataggctttataataggaaatatcattccggagcgaagcagcgggacggagtctttgaaacaaaatgcaagagtttcttccctgccgctttcggcaattcattccgtgtctttgccacgcttgaacaatccgcgaatgtgtccgacaaacccgcagacaatgagcggacttcctagcagcgctaagcacacctcttcacagacatgataaaaccgcgcgagccgaaactcgttgctttctgctattaaaaacaaggcagaaagcagctcaaacatcggtctcgcgcggttatgttttgctcatcggtgtgcaaagtgctgcacgtaagtcctaaaattgtctgcggcttgcggacacattcgcggagtgctccaagcctggaaagacgcggatcatcgcagttgtcgaaagcggctgggttagaaagtccgtattttgtgatcagactccgccccgctgcttcgctccggaatgtgattgtctgttataaatccccgtaaagatcacttctccccggctggctccgtgaaaaccgcccggggcatgccctattttccggtcagcggctaccgcaggcgctcttcgcggtactccttcggcgacatgccatattcccggcggaacgcgcggtaaaagctggaatagtcccggaacccgaaccgctcatacacctggctgatgttctcaccgcctaaaatcgcctcccgggacgcctgcatccttttctttaaaatatactggtgaaccgagattcccgcctgctccttaaagacgtgcgccacataatagcggctcacgaaaaaggctcctgccagtttttccaacgacagttcctcctccagatgctcctctatataatagatcagattctgatagagatcctgctcctttaccttggcgggattttcttcctcgtacaccatccggttcaagtgcaggatcagatcgttgaccagcagcggtatccgcgcctccctcccaaaacgctccatctgcatctcctcaatcagctgaaagattttaaactgcgtggcgttaaatgtaattacatcactgtgaaacacatttttcccggacacttccgcgcgctgcatcaggtagccgtatgccggagaaagttccatcagccggctggcatattcccggctgacccagaacacgaaccggcggtatgcctgcgcatggttgtgcacaacggcacggtgcctgcggtgcggaggaattaccaccatatccccatagcggagcgggtatctctgcccctcaatctcaatcgagacgtccccctccataaaaaaatagaactcataataatcgtgtgtgtgcgtatccacttttgacgtgtaatgttcattataataatatagttcaaaatcgcgggacagcatgtactgtctggtgctgaatctggtctgtaaatttttctgcatgcgctatttcctcttcgggcactcctttcatgccgccattgatccgttgctttcctttttcgtcttatattttttcaaactcttccctgattatagcggaagatagcaacttttgcaatgtatgcaacaagtctttcaatttgcttttggagcggattttatataatgaaatcatccaatatgacacttccttaacggagcagaaaagaacggaggttacacactatggaaatgactttaagatggtacggttccaaatttgacaccgtcaccttagagcagatcagacagattccgggcgtgaccggagtcatcaccaccctctacgataccgcaccgggtgaggtctggagcagagagcgcatcgccgcattaaaggcggaagttgctgccgcaggacttcatatttccggtatcgagagcgtcaacgtccacgacgccatcaaaaccggcgcaccggaccgtgatctctacatcgatcactacattgagacactggaaaatctcggaaaagaagatatccatctcgtatgctataacttcatgcctgttttcgactggacccgcacggaactcgccagaaagcgtccggacggttctactgtcctcgcttacacccaggaggctgtggatgccctcgatccggagaaaatgtttgagtccatcgccggggataccaacggcagcatcatgccgggctgggagccggagcgcatggcgcacatcaaagagctttttgccatgtacaaggacattgacgatgaaaaattgtttgccaacctgaagtattttctggagcgcatcatgccggtgtgcgacaagtatgacatcaacatggcaatccatccggacgatcctgcctggagcgtatttggtcttccgcgcatcatcatcaacaagaaaaacattctccgcatgatgagcatggtcgacaatccgcacaacggtgtaactttctgctccggttcctacggaaccaacctggagaacgatctgccggatatgatccgttccttaaagggacgtatccattttgcccatgtgcgcaatctgaaattcaacagcccgacagactttgaggaagccgcacatctctcttcagacggcacttttgatatgtatgaaatcatgcgtgccctctacgagatcggttttgacggtccgatccgtccggaccacggacgtatgatctggggcgaagtcgctatgccgggttacggcctttatgaccgcgcacttggcgccacctacctgaacggactttgggaagcaattgagaaaggagctgcacgctatgaagctaaataacaaaggattagaaaataagaacgcatgggaagctgccggttacgcacttccgcagtatgacagagaggcggttgccgccagaacaaagcagaatccgttctggattcatttcggagccggcaacattttccgtgccttccaggcaaatgtggtacaggatcttttaaacaagggagatcttgaccgcggtcttgtcgttgccgagggttacgattatgaaattatcgagaaaatgaatcatccgcatgacgactacagcattcttgtcactttaaaggcaaacggcaccgttgagaaaaccgttgtcggcagtgtgatggagtctctggcactcgattccgaggacgatgcacagttctcccgcctgaaggagattttctccgcggactccctgcagatggcaacttttaccatcacagaaaagggttacaacctctacggttctgacggcagcttcatgccggcagttgccgcagatatggcagcaggtccgcaaaagccggccagctatatcggaaaagtcgcatctcttctgtatgcacgtttccttgcaggtgagaagccgatcgccatggtaagcatggataactgctcccacaacggagataagctcgcggcagccatcacagcattcgcagagggctgggtaaagaacggtcttgccgatgaggcatttgaggcttatgtgaagacttccggcaaggtatccttcccgtggacgatgatcgataagatcaccccgcgcccggacgcttccatcgaggagattttaaagaaggacggtgtcgaggaactggatccggttgtcaccagcaaaaacacctatgtggcgccgtttgtcaacgcagaggaatgccagtatctcgtcatcgaagacaacttcccgaacggtcgtccggctctggaaaagggcggtctgatctttaccacacgggagaccgtcgacaaagtcgagaaaatgaaggtctgcacctgcttaaacccgcttcacaccgcacttgctgtttacggctgcctgctcggctacaacttaatctccgaggagatgaagaatccttctttaaagaagcttgttgaagtgatcggatataaagagggacttccggttgttatcaatccgggcattctcgatccgaaagagttcatcgataccgtattaaatgtccgcattccgaatccgtttatgccggacacaccgcagcgtattgcaaccgatacctcccagaagctggccatccgtttcggcgagaccatcaaagcctatgcggcagctccttctttgaacgttgccgacttaaagctgatcccgcttgtatttgccggatggctgcgctacctgatgggtgttgacgacaacggtaacgcattcaccccaagcccggacccgatgcttgcagaagcgtcctcctatgttgccgatgtaaaactcggcgaggctttcgatgcaaagaaaacgcttgcaccgatcctctccaacgcaaagatctggggcgttgacctgtgcgcactcggcatggatacgctggtatgcgattactttaccgagcttaccgcaggcacaggcgctgttgcggcaacccttgcaaaatataccgcttaatccagagacagaacaatcctttttcctgttacttatcacgtcaagaggggctgcccgcttcatgcggcagccccctcttctatgtacgatcgctataccggctgctgaccggaaaacatcgaaaaatactcctgtgctctcccgctatatttttgtttttacaaactgatatatcttttccgcactgtgtttttccattccctggcactgtgctctctgcatcgcgtttctcttcccgggattatgaagcagctgcattccttttctgaccaggccatattccgtgtatgcggtcacgctcattccctttttgacaaaaaagctccgattctttgtctcacatcccggtatcggctttgtgtggacaatgggaatctccgtcactgcggcctccgtggaggtgagtccgccgggttttgtgtaaatgatgtcacacgcatgcagataaaccggcatgttgctgacgcttcccaggatcgtcatcctcgcatctctgccgaagcgtgcctgcatccgctgctctagtttctgattgctgccgcagatcagaatgaggtgctcctccccttgtatgcgcctcagcaacgccggaatcagccggtcgatcgatcccgctcccatgctgccacctgccacaaggatataccgctgtttttcttcgagtcccagactttttttcgccgcctgctgcacctttttgcgcacaatgctgtgcgcgtgtgtatccgccgcagcactttcttccggcgtaccaccccacggctcactgcatgccgccgccaccggaatgcccgtcaccaccagcttttcttccggaatcccgcgcttcacaatctccgggatcagactctcgtgcggaatcatataatagtcgcagtccgtctcttcccagaacgggatacaggtataatccgtcatcaccgccaccgtgagcggaagcttcattccctttcgcttcatataggtaatggtttccgccggatacagatgcggcatgacaatcacgtccgccggatgtttcttcagatacgccgccaggtagactgccatcttcccattgacataatagaccggcgaacgacggagaagccggctgacaagcatgccgatcttatacaaaagtccgaacagacccggggcaatctttaccgtctccacatagacgttaccgaccgtcctcgagaccttctctcctgcaagcttaagataatccagcaccaccgcctcgtccccgtgcgcacggaaagtctccgcaaccgcgcgtgccgccgcgttgtggccaccgcctgtattacatgataagatcagtacattcatttttttcctcccccgggcatccgaatgtgtgccggtagataaccgtttcggcaatcagcaggcctccgatcagaaccggccgctcctccaccgcaagacaggttcccgctgcaaagcacagatacgtcacaatactccgtctcacatggcttttgatcttaagcaaaagtgaaaacagcagataaaacagcaccagcatcgctaacggctgccagattcccgccggcaccagtcccagcagaaccccgaaggataccgcgatcgccttgccgccgcgcccgcggtgataaatggaataggcgtgtcccagcacaggcgccgccattactgccgcaaaccacagggattgcagaccggcggtccgctcgcacagccacaccggtaaaaatcccttcaaaagttccagcagcagcacacaggttccacagactgcgccgccgtaccggaatgcattgtaggttccgggatttccgtcctccgacatctcccggatatcgatatggcgggtcagcttcggaagcacataagcaaataaaatgcttcccagaagatagccgccgatcacaaatcccagataactactcataaccgctgctcctctcgctctcgttttctaacactgatatgtaatgtaacatattttctttcataagaaaagacagggcggcagaaactctttctgtcaccctgtccttttcgtttatttccattacactcccctgtaataaaaaagaatcttgcttgcgagattctccgcgcgcgagcggttcgcaaagcgatattttccttaccgcgagctgcgcatcctcgcggagcgttttttatttcataggaaagttccactttcacacatgaatgtatcacggtatttcctatgaaataaaaacaaaaccggatataggaaatgccctcgcagacgtttttgtcactcacgcagcaggtacgcatccctctctgctcccgtagataccagataaatcggatgatccacgagtttctccagtgtacacacatattttctggcattttccggcagatccttccagcttctgcagccggaaatatcgcattcccagcccggcagttcctcgatcaccggttctgcctcctcgagtctgctgtccgtcgggaaagaatcaagcaacacaccgtgcagacggtatcccgtaattaccggaattttatcaaatgctccgagcacatccagtttggtcagtgcaatatcctgcgccttctggcaccggatgccgtaacggcttgcaacagcgtcaaacggtccgacacggcgcggtctgcctgttgctgcgccgaactctccgccgctctcccgcaatttttcattccaggcttcgcccatcgccgtctccgctacaaacggtccctcgcctacgcatgtggaatatgctttcatgacgcctaccacgttgtcgagcgcgcagcccggaataccggcaccgatcggggcatagcttgcaattgtattggagctggatgtaaacggataaatgccataatcaatatcgcggagcgctccaagctgcgcctcaaacagaatatttttcccttgaccggcagcagcaccgagcaatgttcccacgtcgcagatataatctttgaaaaattctgcctggcttctgcaccactccataatctcatcataggagagcggttcctgattgtatacattctccagcaccagattcttgctgtcgatgataacttttaaacgatgctgtacggacggcgcatccagttccagcagatcgcccatccgaagcgtctttttcatatatttatctccgtaggcgtaggcgatgcctctccgggtcgatccgaatgcggaacccgtcttggaaagccgctcctcctcaagcacatcctgtctcacatggaacggcatgcagatggtcgccttatctgaaatcttaaggttcgacgcatccacttttactttcatatactgcatcattgcaatctcatggcgcagatgatccggatcgatcaccataccgtttcccagcacacagactgccgtcggatgcaggataccggacggaagcagattcagcacaaattttccctgatccgtcaccaccgtatgcccggcgttattgcctccctgataacggacaacatagtccgccttttctgtgagaagatccacgattcttccctttccttcatcgccccagttaattcccgtcactgatgttaacataataattgcctctctttctaattgcggatgtcctccagcttcttggacactcttgtctttctttttcttccggtatagtctgcgcggatgttctgcacaatccggttaaaatcactgtccgccaccgccacatcacagcaggtctccgagtctttgtctccatagacaatactgtgatgcacatgcagcatcttcataagccggtcaagcatgttccgcgggcttgcctcaatcgacagaatcttgagaagactcttctccccgaatacgtgatcctccaacaggaatttcagcttcccggcgaatcccatctcctcaagctgcttctccagcataatcaaccggttgtgcgtgtccagaacactgaaatacaaaatatgatcttcatcgtgcggtgcacgtttcatatagttgcggtacggcgaagtccggagtttctttaagtatcctttctggtcctcgtccaccagatcgttatagtaaatcacccacacgtcatccacgatgacattggtgaaaaatgcgcggttctgctccgtcaaaagctgccggatacggattcccatatcgtgctccatcaggcatgcatgcagatacctgttctgataaatatcatacagaaccgctccgtcaagggcgatcaccggcaggcgcagctttaagtgctcgacctccgcaatcaaagacgccggtgtctgtctggtaatcatggtaaaaagtgcgccctcgtcaatcatatgatttaatgctgtcttgttaaattcgctgatctgccggtgcgcactgcgcagctcatcatccagctccgccacgaacagcacatcgttgcgcttcttcccgtgtgtgtgaaaactgccaaccaggctgccgattcccacgccgaggaaagtatccaccaccctgtaaaacaggaattcatacggcgatactccatcatgtgtgatgaccgcaacgcttaaatacgccacgcacgccatgaacgcaatgtactgtttgccgagcagcaccgtcagataaatggtaatgcagatcattaccgcgtttaaaagatcccaccacagttcgcctccgggcagacccttgaccggcatttccagaaacatcgccaccgcaccggtgaccgcgccgatcaatgttccgatcgcacggttgaatgccgtgtcctttgtgtttgcaatatccggctggatacagatgatcgtcgtgatcagaacgtagaacggcgaccgctttgcccctaccgcagtaaaaatcaacaatatcaggaaagccgctatcgatgtttttataatcctcatgccaatgcgcggcatactttttttcatgcttctcatcccttttcagacacttctggcataacgttccatctcttcccggaaccccagcgcaatcccgtttgcctgctcaatgttgcgctccatggcatcgccaaaatgacgcagcggaaggaaaattcccagttcctcgcttccggtctcctgcccgtttacctgcattttcccgtaatacataaaggcacgcggcagcacatcttcaagccgcatcagcgcgtcccatacatggacatacacctgcgcatccgtcagatgctcctgcaaatgttccggcatggcatagagcagcaggattcccagatgtcgcccgatctccacgctctccaccgacagatcctcctcgccgtagcggtgctcctcgcggaaaccgtacgccagatattcccgcatctgtgggatcggctccctgtgctgatagattctgctgaacttctggtaaaccttgtccgggacgttcaccgggagcttctctcttaagattccctggtcatcggtcaaaagaatcgggtttgtcttgcccttgtcgtcaaaccggatcgggatcagaaaagagttgcgcagcagatcaaacatgctgtttccgcagatcgccatcagaaatgccgacagatccttgttctggtatgcctgaaacagcgccctcgtaaaagtctgtggcgataccgccggcatctgcgcatccatatcctccgattccggaaaatgctcataaaacgtatccttcagccgctcacacgcatccggattttccagaatcttctcgaacaactgctccgctttttcttcccttggaaaaatagttgccattacactctcccctttctgtctgttctcacctgttccatacacgcagcttttccaggaacattaacagcacgctcaccatcaaaagtccgcctgatacccagatcacatgtactccgtaacgaaccgataagttgccgcctgccccagcgcccagcgcgaaaaacaagatgatgccaaaataataaagagcctgctttaaaaactcgggacggcgctccctgaaatacatggaaagcgatgccgtaccactccgcagattgccgatgcacatcgtgctggcgtaggaatagccgtccaccttccggaatgcctgcacctgcatcgcacaggagaacgacaccaggatggtcgccgtcatgttgagggtctgcggaaggaatccgacaatcagaaggattgcaatttccagaagcagaattccctgccgccagtgcagccgcctggcaaagcggaactgcgcctgtatccgctccgccgccagcacgccaaacgcgaatgccagaagcggcagcagatacttcagcccgtccttccactctcccatcataaaatgctggctcatcaacaccacattgcccgtctgcgcgttggagaacaccttgtctctggtaaagtaggtgtatgcatcctgaaagcctccggacattgcaaggaaaatactgttgataaacgcttccgacatctgcttttccggaagtacctgtgtcatccagcctgtgaactttccctttttcacctgtatcactccaaactctcttgctttcttgatccttctgtattatactgaccgaaaatagatatgtaaaaagtatattttatatattggatatatcaatatcatatatcaaggagtgcaaaaggaggcacggatcatgacgctggattactaccgcattttttactatgttgcacaatatcaaagcttttccaaagctgctgagattcttgggaacaaccagccgaatctctcccgctgcatgaatctgctcgagagcgagctcggctgcaagctgcttgtgcgcaccaaccgcggtgtcagcctgacgccggagggggaacgcctcttctcccatgtcgctatcgccaacgaacagctgatgctcggggaacaggaaatcttaaaagacaaaagtctcgaaagcggtcttgtgaccatcggcgcgagcgagacggctctgcgcctgtttcttttgaacaaactggagcttttccaccacaattatccacatgtgcgcctgcagatttccaaccattccacaccgcaggccatccgtgccctgtcgcacggcaccgtcgatttttccgtggtgacgaccccgatcgacatcaaaaaacctcttcacaagacgtcgcttttatcctttcgcgaaatcctgatcggaggttcttcctatgccgctattgcctcccgcatgcagagtctgcacgacctgtcggaggttccttttatctctctcggagccggaaccggcacgagagaattgtattcccagtattttctaagtcatcatcttgtattttcaccggacatggaagcctccacgaccgatcagattctgcccatggtcgcgcacaatctcggcatcggcttctatccggaagcactcgcctccgaaccgattgcgcgcggggaagtgcttcccatccgtctggtcgagccgatcccggaacgtgagatctgcctcatccgggacacaagccgcccgaagagcatcgctgcccagaagctgatggaacatctgcagagcgatacctgaaacgacaccgctcaaatgcttttttctgcaagaagcgcctgtatttcctccggttccggcatcacgcgcagcgctccgcgtcgtgtcgtgacaatcgatgccgccgcatttgcaaaacgcagcatctcttccaactccgtcgtgccaaatcccgccacgccgtgttccagaatatagtgcaggcagcatgcaccgaacgtgtctcccgctccggtcgtctcgatcgtgcccgcctgtataaatgcaggttgttcggctctgcggctgctgcagtatgcccggcttcccccgcttcccatcgacaacagaatcagaggaatgtagtattcccgccaaagcatgtccactcgcggtcgaaatcctcctcgccggtaaatcaccagatctcattgtccgatattttcagcacatcgcacacttccatcccgtaagcagtctgtctcttcgtctcttccaatgaccgccagagcggttcccttatgttcggatcaaaggagagcatcgccccgtttgcctttgcggtctcaatggcatgtcctgtggcgcttcgcaccggctcatccgtcatcgagagcgtgccaaaatgaaatatgcgggtgtcctttaagatctgctcctgcagttcctctgtacgcagcatcatatccgcgcccggattccggtaaaaagaaaaaacgcggtcttatgtccaaacttctgcagcattgccagcacattgcagggtgctccgcccggattcgcctcatacatgagattcccctgtgcactgctgccgttttccgtaaaatcaatcagcacttccccccgcgtacgtctgcgccgcatacggcagcttcctgagatatgcctcgtttacagtaattacctttaagatacaatcatctgcttcttcaaactgtctcctgccttccagtttttcatattccataaaataatttttatcatcctttatatccgaaacctgacagcaatagtcaattgccagctgctgatataattttcttttatatcatccatatccatcacctcacactacgataagctgatcatccacttacgcctcttaaaaataacaagcgctaccaccagcctgaatatttcttcggtggtaagcagtgtatacacaccaactatgtcccacttaaatgcatatgctgcaagcagacacagcgggattccgatgcaccatgtgccaacaatatcaatcatcataatcattttggtattgccgccgcttcttatgataccgcctccgagtatcatattttcaaccttgaccggtgcatacagggcaaatacaataagcaatatctttccaagttcttttacactgtcatctacacgatacagcccggtatatactccagccagaagaatgagcaatatcgatactgctgccgcaccaattaagcctgcatacattattttcttcgattctgtataagcctcatcatactctttcctgccaagcctcttgccaaccattacaccggcagccgccgacaatccgctaagcgctcctacaataagcccctgtatcggacaggtaagtgtgtatgccgccagatttgccattccaagatgcccatagacggcagactccacattttgtccgaggctccacaaaaattcactgaccagaatcggcataatcatgatcagataatccttgatagtaattttactgaaacgcaatgaccataccggtttatcttcatcctttctgatacataaggcaaatccaaccgcaataaataccagattaaataactgcgaaatcagtgttgcgatcgcagctccctttattcccatacatggcaatccgaattttccaaatatcagcagataattaagacctgtgtttacagcgactgccccaaagctcgcccaaaaaggtattgtggcatgctccctgcagcgcagccacgaagataaaatattgccggccgccattggaatataggagaacgctactatcctgaaatagaccgcaccggtatttacaatactcacatccctcgtgtacagcccaagaatctgcgagggaaaaactcctgctgcaaacaaaaacagcgcagctattaccattccgctaataaggctcacatcaaaactgcaccatgcctcttttgtatcttccgcaccaataaactgtgcgatcagtatccccgcaaccgtactcactgcaccaatcactacagaaaaaatcagcgaaaagtttccacatagtccaactgccgatatgttagtctacactaactgtcctatcataatctggtctacaattgaaaaagatgcctgcagcatactttgcaaggtgacaggaattgctattttacacaatgttttcataaatttcgacattataattcccccgtactttctctcttaattaactcaaccggcaacacaatttttgtctcacattctgctccatcgcgcattgcctcaagacacttaattgcagtttctgccctaagggacgcctcctgatgaattgttgttagagaaggatggctttccctgcttgccatgttgtcatcaaatccgattatctggatatcccttggaatccgaatgttctttccctgcaaaaacctcataaactcaagtgcatagaaatctgataccgcaaaaacagcggtaacatttttctctaacagcgcctgatatttatcctcataaaaacgcattctctccttttctgtccttggtattttccatcttaatgtttctcccggtccaaaggcttcgctaaaaccttcgatgcgctctttatccatgcagataaaattgtccgctatgcacaacgcttttttatgtccaagctccctaaaatatcttcctgcctgataaccaccgtcataatgattgatgaccagattgaccaccttggaacatttttcaaaataaccatcatacactacaaacgatatccgcatctgatttctgagtttctcataatccgcttcacaaaaacccatcagaatcagcccatccatattccacatagatgcaaacaccggaatctcactgatgtcagatgtcgtttttatcatcagaaaatatcctttttcatttaccccatgggagagagcatttattgaagccataacaaatccatcctctaaaaccctgccctcatacttttcattatcattcaccaccactccgatgattcttgaattattcctggcaagcagaatagctgccatattcgggatatatcccgacctctccagctcctgctggacgcgttttaccgtctcatccgaaatcttttctgtttttccgtgaatcacctttgagacagttgcagtactaagacctaatgaatctgcaacatccgcaatccgaactctgtcctgtgccatatgtattccttcttttcctatattctgattatatggtacaacagaaatatgtgtgttacaaaggttaagtgcataacccatgacaaaaattgcattcctgcctcttgcatacggttatgaagtatgtccacctcttgcacggtggcgagccgatgaactttctgtaatagaaaaacaccctacattgctgcaaggtgtcgatgttgtatgcatcttttatctctggtgcgtatttcataatcatgtctgcaagaaagccacagcagcatccaaaatccttgttcattgccaagcctcccttaaatgcaagaatttcttactattttacaagtgaagtttggactatacggtctttggtcagcaatgcctgatgccgaatttctgacactttttatctccatacctcttttgaaatggaaaccatctgcattttctcaaaaataaaatacgatacaacatcatatcgtaaaaaagtaaagcatatgccatgttgttttctcctatcttcccaccagctttaagaatttcttatcattcatctgctcattcgtaacatactccccatcacaaaatagtgcataagtcgtaatcggtgttggtacattctgagcatccttcctactttcgatcttcacagccttgaatggaatgccattcttctgagcggtttcttccaggattggtacatactttgcattgaaaggacattggtttgtataataaagaacatagccacgttcatttatatgagggtgttttgcacattccttgaacaccggtggctcagttttctcttcaaatggcagataccataactggattccattatcagcctcatcacaaacttcaaatcctttatattttagaaacttcggatcagccagaaatggctttttccttgctgccgcaagaatacataggccttccttccccttttctctgctgtcctcaatacacctggaaagtaagtcacttgaatatccatgacctttgaaagaaccggacacccacaaacaattaatatacatataaccaggtgcctcgattggattccatgcacactccgcaggtatgtactcaataaagcacttgccgcgttctacgctcttaagaaacacaagaccttcatcaaatctatccgcaagccatgccttctttgatgatacctgaatatctttattgtcggaaatggcacagcaaatatgctccttttcaagattttctttcgtaactctaatatattccatacctttaagccctccttatcggatgcctgaccacagtcttcaatttctcaggtgccactctccgcgcatcactcagataaatctcgtggtgcatcctctgatccgttatatcaagtgtatatccctgttcttccataaatctgtgcattgcatctaccgtagcaggctcatcgtcatacgctccgatatgcatacactgtacacataagccctcctcataggaaaaaaactcaaccttagaaaaatcctgttttttctttgccgtagctttcctgacagcccagtcgaaattctccctggtaacaaaatctggcaagcgaataacagaaatccacttaaaatcttccttacgagcataatcaattccggatacgccgtctcgcctgccggctcggtcggttcgcagcatggcgtcccccggacgccgctcaccctgccaccagaatccctctaatggcggcacgacataatcgaaatatccatcaatctgatgatcttcctttttgctcattttaatcgtaaatgcaattccatacagaagtccgatagcctgcttgtattctccgtctgcatcatttggattgccgcttccccttaccgctatatagttcattttcggaacagttacgatagacggtgtgcctttcggcatataaaattctttatattcttttttataatcaaatgtcattttcctaatcctccatagatttttaatgtttcttccgcattcctgcggataatgtcccgtgcttcttttggttcaagcacctctacttttgctccaaatgtcataagccatgtcacaaggttttccatatccgtatagtctgctgaaaagagcagccttccatcgtctgtttctgtaaagcagttcggtccaaattcttcaaccagccgccacttcatattcggtgtgaaaagagcttttacctttatcccacccggaaatatcttctcatttgacaaatccggcattggtacatctctgcacagaaatccacggtctgtttcaacaacacaatccatacggttcagtttgaacagcctgtaatctttacgttctaaacaccacccccatacataccagctcgaccactggaaaaccagataatatggttctacccttcggttgctctctccggacggagcataatacttaaatcgtatgatgcgcctgttttctattgcactctgtattacctcgatctttggagcaagggaacccttataccatgaagataagtcaatcagcatagagtctcttccactgatgaactctgatgatccggtctggattttctccatcagctgactgtagtatctgcttccgctcacactgtcaagactccgcaaacctgcaagaatcatctgcatatctttggatgtcagtatcgtcctatccatacgatatccgtccataatacttataccgccaccggttccctgtgccgtccttattggaatacctgctttgcaaaggtcttcaatatcccggtttattgtcctgcgggatacctcaaatttttctgccagttcaggagccgttgtcttttcttcctgcagtaagattgacaatatcccaataagcctatctatcttcataattccactctccatacatatcatatctaacacaacacgacaactatatgtcatgtttattatatccacaaaaaaattttctgtaaacaaaaagcctacgaacatcaggttttattcccaatgtccgaaggctctataacattagttaaattttctctttcttataagccgaatcatcctacgattcacttggaatcatctgaaaatatctcagtgcctctacgattgcctcctccacttcatctattttatcatattgggtatctaatcgtctctgtaaatctgaaattttttatcgtaatgaatatctgtaacatccagattagcttcatgaattctccaacagttgccgaagttgcaactataattgagttttcaggaaacagctttccctttactgctttttcagaaacatactgtatagcttttgaaagaatatttccattttctctaatatcttccattctaaaccatggaaccgacccattttcccaaaattctttatttcccttagatggagtatatccatttcttgtatgaaaaagctcagataattctttatactccatcccgtctgggcagaattcttcaatcaatttatcaagtttattcattttttgtcaccctcgtcagacatacactgttttttaaactgtcagttacacatttttgagccatctcgtgatccagatgctcaagtttgtcacgcatgtcaaatattccaagtttttcaaccatttttctacatttcgattcgtagtcatcaagatacaatggtattctatctactgtttcctgttcttttaacttagaaatatatacctgctgttgatacatagattttagtaaatccgcaaatgatgaaacaaattcgcctgctatccgagcagtctcgccatcaaatatcattgaaatttcaatggctaaattttttagcttctcatattttgtgagcagcattttttgttcctcttgatgtaacggttttgatacagcgagtgtcatttcttctaactcaatacagtttgttagccaagaaaaaaccaaatcgtttgtgtgataaaatgtgctttcatctttcaaatataacttatttgatacatataatttgtagattgtattaaactcaagaaaacacgaaagccgtctatcgaataattgctgtttgttgctcaaagcaatctgttgtttcgtttgaaatattgcaactagtgcaatgataatcgaaacgattgaaacagcaatattgactatttctgaatggctcattcctcaatctcctccccatcatcattctcacctgcatccggatgctgcatatagaaaatctctttctggcgttctatctcgactttcagttgttcttttgtcggaagacaggtcagatactttgacataaacaaatgatcgttatcgtgcaatacagaatatcttgcaatatcctcatccgtttctgaacagagcaaaatgccaatggtcggattatcccccggcttgcactttaaatcatcatacatccgcacatacatatcaatctgcccgacatcctgatgcgtaatcttacccattttcaaatcaatcagtacataacacttgagttcaatattataaaaaacaagatctatataatagtcttccgtttctgtgactatgtgttgctgacgggcaacaaacgcaaaacctcgtcccatctccatcagaaagtcacgtatatgagatatgattgccgtttcaagatcactttccaagtaactgtcttcattcttaaagcccaaaaactccgccatgattggatttttcagcaactcaaaactgtttttttgatagcctactgttttttgcttcatctctgcaatcacattttctttttggggagattgcaaaagacgattataatattgtgtggaaatattccggtcaagagttctgctgctccaaccttcttttgccgcttcgttcatataccaaatacgtgcattttcatctgacacacgcaaaagactgcgaaattgcgtccaattcaaattcggaacgcatgcgttccaaatctccttgtctggaaaatattggtagaattttctaaaatatcgcaaattacgttcagaatatccgtttccatattctttcgtcaattcatcagacaatgcaactaatagttttttcccatactcagcatgctcttttcccgcttgctcctgctcaacgattctttttcctacattccaataagtcagaaccattgccttactggcggcaccatacgcctcttgctgccctgcatttatgatattctttatatctgtaataacagactgatacaccatcagattattttccatatcatcccacctcgatttctgcgataatcttatcaatctcatcacgaagcacttgttcacgggcaacaatttctttaatttccgcattcagcttcacaatgtcaattttttctctggtatcctctgcctctacataagtggagaccgacagattataagcgttctcggatacttcctcataacttgccagatgggaaaaatgttcgatttcttcacgcttagcaaacacatccacaatacggtcgatattctcttgtgtcagcttattattgttggtcacctttacacactcgcttgtggcatcaataaacagcgtcttattgtccgtcttattcttcttcatcaccataatgcaggttgcgatagaagtgccgaagaacaggttactcggtaactgaatgatgcaatccacatagttattgtctaccagatatttacgaattttctgttctgcaccgccacgatacataattcccggaaaacatacaatggcagcagttccgttagacgcaagccatgacaagctgtgcatgataaatgccatatccgctttgctcttaggtgccagaactccagccggagcaaaacgaggatcattgatgagcagaggattttcgtctcccgcccacttgatagaatatggcggattagacacaatcagttcaaacggttcatcatcccagtgctgtggactgagcaatgtgtcttcacaggctatatcaaatttatcaaaacccacatcatgcaaaaacatattgatacgacacaggttataggttgtgatattaatctcctgtccataaaacccattacggatagcatcctttccaagaattttctcagccttcagaagcaatgaacctgaaccacaagccggatcatatactttgttgatttccgtttttcctacagttccaaggcgtgtgagcaattctgacacatctgccggagtaaagaactctccaccagattttccggcatttgatgcatacatggtcataaggtactcataagcatcaccaaaggcatcaatggaatgatctttcacatctcccagattcatttcacctacgccattcagcagtttcacaagtttttcattgcgctttgcaactgtagaccccagtttattgctgtttacatcatagtcatcgaacaatccggcaaagtcactctcagcctcactgccctttgctgattcctcgatatgacgaaacacacgctccagcgtctcattcagattttcatcatttgcggcgttggttcggacattacagaaaagttcgctcggaaggataaaaaatcctttttcctctaccaatccctctcttgcctcttccgcatcctcatccggcatttttgcataatcaaaatcagtattgcctgcatcaatctcaccgctgtttatgtaattgcacagattttcggaaatgtagcgatagaacatcgtgccaagaacataatttttgaagtcccaaccatcgactgctccacgcagttcatctgcaatcgcccatattgcacggtgcagttcgtcacgttcctgttcttttttggtatcaaccattctcttttcctccgttattctctggtacaaattccagaatatcgtcaacgccacagttcaggacatgacatatactctctacgctttcgagggaaatatacctattacgtttcagccgtgtgatgatatttgcggagaagccagcctcctgctgcaactgtgcatttgtcatatttttttctatcagtaaatggaataattttttgtaactgactgccatgtcatcctccctcatttttccaacagatttaagaaaagtttatcacgaaaacgtgattttttcaatctgtacaatcatcccatccatccttatacaatcatcccatccatccttatacaatcatcccatccatccttatacaatcatcccatccatccttatctctagataagatagatattattcatatccgtcttaataccctcagtatcattaccttgtccttttgacacttccataaccgaaaaaaagacatcccatgccccgtaaaactaacaggtctggaatgtcctttttcctctaattaactgtatttttaacaatgagaagtcaactttcactctccggctgtcggtcattcaattagacaaaaggcataccgtctccacatgtgttgtatgtccgaactggtccaccggccgcaccttccgcagctcatagccacccccacacagaatcttcagatcccttgcaagcgttgccgggtcgcaactgacatacacaatccgttccggcttcatgcgaagcatcgtctccagacacttctcatcgcatcccttccggggcggatcaacaacgatcacatccggatgaagcatgtccgcatccggcttccggctctccttttcgtagaactccggaagaacctcctccgcctttcccacgaaaaacgaggcgttggtaataccgtttaatgccgcgttgcttctcgcgtcttcaatcgcctgcggcacgatctccacgccgtagaccttccctgccttctgtgccagaaacagggaaatggttccaatgccacagtatagatcccagacggtctccctgccagtcagacccgcgtaggaaagtgccagactgtacaacttctccgtctgcaccgggtttacctggtaaaaagactgcggagaaatgtgataggcgattgccgtatctgtcagtgcaaaatcatggtcacagtcgcgcagatgaatctgatccgtgatataatccgatccccagacggtccgggtctcctcccccaaaatcacattcgtattcttccggttgatgttcacggaaatgctggtcataccttctattttacacaacgcatccaccagtttcttctcctgcggaagtgtctctctgttaatgaccaggcagaccatcagttcctttgaggtgaatccgtaacggatcagcacatggcgcaccagtccccgccctgtcgtctcatcatacgaacggaccccattctcacgcatataggaaagcaccactccaagaatctgctcattctgcgtaacgcccagcttacaatcctctaccgggataatgttatgcgtgcgcgctgcgtaaaatcccgccaccggcatcccgtccctgtccgcgccgatcgggaactgtgccttattgcggtaacgatacggctgctccatccccacaatctcctccatcacggaatcaatgagttccggcgcaaatcctccgatacggatcagattgccgcgcacctttttctgcttatagcaaagctgctgcctatagtccatcgcctggatctggcagccaccacagcgcgcatatagcggacactccggcttcacacggtacggcgacggttctaaaatctcctgcaccctggcatagccgtagttcttcttgagcttcgtgatgccggcacggatcgtatccccgatcacagcatctttcacgaaaaaggtcatcccctcgtattttccgatgccctctccgtcaacgcccatatcttcgatctttaactcaatactgtcgtttttcttcatatcctgtgatatacctatgactctcttcctgatctgcggatattgctctccagcaggcggttatatccctgccactccagattgttctccggaacacttgcaaaaatctcccgtattgtctccatcttggcgtcaatattgtccgcaaaactgagtgccagtgcctccgcaagtgccggtttcttcggcgaaccgtattccagttctccgtggtgagctaaaatgcagtgcttcaactcattggcggttcccttcgggaatcccggaatcgtgcggatccgctctccgaccatctcggcgccgatcatgatgtgtcctaaaagctgtccctcatccgtgtaatcgttctccgggaacgtcgagagttcctccagctttccgatatcatgaaaaattgccgcagacacgatcagatcgcggtttaatatcggataggttgccgcaaaataatcacagttcttcgtcacagagagcgtatgctccagcagtccgcccacaaatccgtgatgcacgctcttcgctgcggaatgaaacttgaaccgtttttcaaaatccttatcctcgacaaaaaagctctccagaagctttcttaaatacgggtgcttcacggaagcaatcagtccgagaagctctgtatacatcccgtcgatgtcctttttggataccggcagataatctttcggatcgtattccccttcctgcaccttgcgcacacgctttacgttgagctggagatttccctgaaaacttgtgatgtctcccatgactgcgatgtagtctaacgaatcaaactcatcgattccaaccgagcccggctcccagatcttggcgtccagtgtaccggtcttatcctgcaggatcagattatcataaggctttcccgcctttgtcagcgctgactgctttaccttgcacaaatagatttcgttgattctctcgccctcacgcaggctctcaatatacttcatttctgacctcatttccataatatggcggtgccgcaagacaccgccttctgttactatcctctactttaacactccgacctgtaccgtacaggtgatctcctcgtacttctccgcgccctgccgctgtacaacgatctccacctcgtcgcccggtttcaatgccagaagcttgctctcataactgtccaccgtgtagacagcttctccatccatctctgtaatgacatcgccgctctgcagtcctgccgccagcgctggtgaatccatcttgacttccttgatgtatgcacccttcggaatgtcgtattccttggcggttgccgcagaaaccgtcgtcagtcccagaccgatatacggaatgtcctgattgttggacagcttctcgatcaactgctttaactcggagatcgagagggctgtgagcgtcgtctgatcctcctcattgccgtaatcctgcattaccagaccgatcacctcgccgttcacattgatgatgacgccgctgccgctgctgctgcccacaatatccgtcgtaaagacggtataattattgtcgatcgtggaaatcacattgttggtagatgtaatattccccgtaaggatcgaatagttcgttccgagcggacttcccaccgcaataaccatggttccctgcattgtagtcagtgaattcccgagcttcgccaccgagattgcattcatggtatcctcatccacctgactgcgcggcaccgagagcactgcaattcccgtattgccgtcgtagtgcttcatggacgcttccaccgtcacatcattgatgaaagtaacatagacctcctgtgcatctgagatgaccttgcgctcagttaaaatcagaagttcctgaccgctgtctgcaatgataatgccggatgcctgtcctctgctctcgtaagaattgttgaaccagtccgtgtcgctcttgacccccgtcacggtcacgacaaagcggtttgcttctcttcccaccgcatacagcttgttctgcacgttctgtacatccgcaatctcaagctcctggggctgctgtagcggcggttcctcggaaggtacctgtggttcctcggatgtctccgtctcctcggatgtctctgtctcctcagtcagctccgtcagctccgtcaccgcaaccgaatcctgcggaatggtgaccaccggttcctcctcggggtaaaacagtgattcaaacttaggctgaaaatacgcgaaaaccagacttgctatgattccaaaaacgactgccatcagggcaataaaacctgcctgcatcagcaatcgcttcttattgaccggcttttctttgattttttcgttaataaaagaaaactgatcgttatccttttgctgcatgatttcctcttttctgcatgtatttacacacgaatttctgaaaaccgtaccagtaatcattataaaatgaatcacatacgcttgcaataggattctacaattcttttcaggttctgctttccaagactcccggaatcatatataataagaaggacataaccatgtgacaatcaaatcaaaggaactgctatgaacgaaaaagtattacacaccttagaatataacaagattctcgatcaactgaccgaatatgctttcagcgctgacgccaagtcgcgctgtcagaagctgcgcccgatcaccgaccgcgcgcagatcgaacagctgcagcagcagacatcggatgccttaagccggctgttcaaatacggctccctgtccttttctggagttacggacatccgcgattcgctaaagcgcttagagatcggcggcgccttaagcgccatcgaactgctgcgcgtctgctccctcttagagtccgcgaaacgcgcgaaggcttttgccagatcacaggacgacaacgatcagccggacgattccctgaccagtctttttgccggcatcgagcctctcacgccgctgtgtgacgagatccggcgctgtattctctccgaggacgagattgccgacgacgccagcagcacgctgcactcgatccggcgctccatgcgcggaatgaacgataagatccgcgcacagatgaactccatgatcaacaacaccacgaccagaagctatctgcaggacaccgtcattaccatgcgcgacgggcgctactgtctcccggtcaaagcggaggcaaagtctcttgttccaggcatgatccatgaccagtcctccaccggctccacacttttcatcgagccgatggctgtcgtcaatctgaacaacgaatacaaagagctgcagctccgtgagcaggaggagatcgaggtcatccttgccggcttaagcaatctgaccgcctcctacgccacacagctgctcgccgactatgaacttctgaccgagctggactttatttttgccagagcggctttcgcgcagacatacaacggggtcgccccgctttttaatgatgacggacggattcacatccgcaaaggacgccacccgttactcgatccgaaaaaggtcgttccgatcgacgtacggctcggcgaggatttccgcctgctgatcgtgaccggtccgaacaccggcggtaagacggtctccttaaaaaccgtcggtctgctgacgctgatgggacagtccggcctgcatattccggcgtccgagcgctcggaactcggtatttttgacgaagtgttcgctgacatcggggacgagcagagtatcgagcagtcgctcagtaccttctcctcccacatggtcaacatcatccgtatcttagagcaggtcaacgaccgttctctggtacttttcgatgagctctgtgccggaaccgatccgaccgagggcgctgcgcttgcgatctccattctctcgaagctccacctttacggagcacgcattatggctacgacgcattacagcgagctcaaggtctatgccctctccacaccaggcgtggaaaatgcctgctgtgagttcgacgtggcgacgttaagtccgacctaccgcctcttaatcggtattccgggcaagagcaacgcgtttgccatctctgaaaagctcggtcttccgtcggatctcattaccgacgccaaggggcgcatcagcaagagtgagggcgattttgaagacctgatcgcagatcttgagaagagccgcagcacgatcgagcgggagcagttagagatcaaccagtacaaagccgagatcgagtccttaaaggaaaagctggagcagaagcaggagcgtctggattccagccgcaacaagattctgcgcgaggcaaacgagcaggcatacaatatcttaaaagaagccaaggacgtcgccgatgagacgatccgcaattttaacaaatacggcaaggcgggcgcaccggtcagcgagatggaaaaagaacgtaccaagctgcgcggcaagatggacaaagccgcacagaagatgtccgagcagaaaaaagcttccgtaccgaaccacaacgttccgaagaagctgcgcatcggcgacagcgtcaaagtcatcagcatgaacttaaaaggcaccgttcattcccttccgaatgccaggggcgacctgtatgtgcagatgggaattctgcgctctctggtcaacatcaacgacctgatccttctggaagaggatgccgcaccgggcaccaagaagttccagaagaccagtgccggcaagatcaagatgagcaaatccgcctccgtctccacagagatcaatctcatcggtaagacgaccgacgaggccattccgcttctcgacaaatatctggacgacgcttatctggcacatctgccgtccgtgcgcatcgttcacggaaaaggcacgggcgcactccgcaacgcggtgcaggctcatttaaagcgcttaaaatatgtcaaatcattccacctcggcgagttcggcgagggcgatgccggtgtcacgattgccgagtttaaggactgatatttaaaataaaaatgaggagatgatgatatggcagcaaaacagaaaattctcatcgtagatgatgacaataatatcgcagaactgatttccctgtatctcacaaaggaatgtttcgatacccggatcgtcaatgacggcgaggaagccatgatcgcttttgatcagtacaatccgaatctgatcctgctcgatctgatgcttcccggcatggacggctatcaggtctgccgtgagatccgtgcgaaggcaaatgttccgatcattatgctgtcagccaaaggcgagatttttgacaaggtactcggtctggagctcggcgcggacgattacatgatgaagccgttcgactccaaggagcttgtcgcgcgcgtcaaggcagtgctgcgccgctatcagccggcaaagccggaggaacctgccgcagagttaaaatgcgtcaagtacacggatctggtggtcaatctctcgaactactccgtcatctacatggggcaggccgtcgatatgccgccaaaggaactggagcttttatattttcttgcggcttcgccgaatcaggtttttacaagagagcagctattagaccacatctggggttatgaatacatcggcgacacgcgtactgtggatgttcacgtgaagcgtctccgcgagaagatcaaggatcatgccaactggagcctcgcaacggtctggggcatcggctacaaattcgaggttcgtgacctatgaaacgtaccctttaccccaaactgctcgccggctatctgatgtacggtctgatcggttttctcatcatcacaacctttacctaccacattacgtttgcctttgtggaaaaaaaggaggctgccagcctctaccgggaatccgccctgatctcctccaactatgccgggaattatttttccaagaccatgacgctggacgagatacagacacagctttccaccttaagcacctatctctccagcgaaatctggatcgtggacacgcgcggcagcatcattctgaacacggcggcgccgggctgtgatcccacaccggttcccggcttcaacattaccgacttcggaagccgctattatcagaccggcacgttttataaccagtttacgtcagagatgctaagtgttttctcgccgatcaccgtcaactacaaggtgcgcggctatgtggtcatccacaagccgaccagcagtctcgtgtcctacgcgaacggacttgtcgccatcgcttatgagacgcttgggcttctgtttctggcagcctttgtggtactgattctgtttacctatgtggtgtacataccgatccgcaagattacaaaagcggcggacgaatatgccgccggcaactttgaaaaaaagattgatgttcactccaatgatgagatcggctatctcgccgcctcgctcaactacatggcgaacgaactgaataccctggaggacgaccagaaaaagttcgtctccaacgtctcgcatgatttccgttcgcccctcacttccatcaaaggttatgtggaagcgatgctcgacggcaccattcccgtagagatgcaggacaaatatttaaacatcatcctctttgagaccgagcggctgaacaagctgaccaagagccttcttgagttaaacaaattcggctcacacggcacgatgctggacatcacggatttcgacatcaatcacacgatccgcatgacagtccagacgttcgaggggcgctgcatggaaaagcgcattactttcaacctgatcttaaccggcgagaagctttttgtctccgccgatatgagtaagatcgagcaggtactctacaacctgatcgacaatgcaatcaaattcagccacacggactccgcgatcacgatcgagaccacggagaagaacgacaagatcttcgtctccgtcaaggacaccggcatcggcatcccgggcgacagcatcaaaaagatctgggagcgcttctacaagacggatctctcccgcggcaaggacaaaaaaggaaccgggcttggtctctccatcgtaaaggagattgtccaggcacacggcgaaaacatcaactgtatcagcacggaaggcgtgggaacggaatttatctttaccctgccgttagcaaagaagctgtcccatcaggcgggcagttgactttggggcgataagttatattacaggaagcacttgatacagatttcggctggaactgcatatgaaacattcgttggagaaaaatgtgtgtatttcttccagccggatgactgcatctgattccgtgtctcttccacgtttggactctcccggagtgtgtccgacaagccacagacaatgagcggactttctagtgtccctaatggcaccgcttcacagacaatataaaaccgcgcgaaccgaaactcgttggcatctgctattgaaaatagggcagatgccaattcagacatcggcttcgcgcggttatgttttgttcgacataaagatggcataaatgccatctgttgtctggtgccataagggacacacaaaagtcctaaaattgtctgttggcttgcggacatagtccgtagagtgctccaaacttggaaagacacggatcatcgcagatgcagtcaccggctggtaagaaatgccgcattttttgaacagaatgttccataggcattccatccgaaatcgtaggggtatgcttctcatagtataacttatcacacaaagctgcttacctgcttcgtgcggcagcttctttcagatggctccgtcccgcgttctatacacatgcaaatgctgctgattcttccttgagattctttgccacggtactgttctcctccatctgtccgtttacagtggacatggactgtaccagggaatcaatgttcgtggctgcatcggtcacgccatttgcggattcttcgaccgcacggctgatgccctcaattgcctctgtcatctccatcattgtcgccagtatatcctgcgcctcgcccgcatactctgccatcgtgttgtcgatgtgggtcgcatcatcattgtactgctgaccaccctgcacaaacgcacggtaatccggcaggatgttctcgttgatataaccaacaatcttctccgaagaaacaaccagtccctgtactgcctcaattacctgctcattgatcgtctggatattgttcgctgtctcacgcgaagaatctgcgagctgtctgatctcatctgctacaactgcaaatccctttccggcttcaccggcacgcgccgcctcaatcgatgcattcagtgcaagcagattcgtctggctggaaatatttaaaatatccgccgtcagctgtgcgaccttctccacactcttggaattctcgagcgcctggttcatctccgtcgtaatctcgccgatcatctcgttggtgttgttcatgttctctgtcgccgtgtgctcaagctccgtcgcacgcttcttcatatcctgcgcatattgtgacataaccttggtctgatctgccatcttctgtactttgccttccgcggcggtcgtattctcgctgacgctgttcgtcgttgcggatacctcctccatcgttgcagaaagctcttccatgatcgcggaaatatcattggcattgtcactggacgctgcaacgctacttgctacatttccgacaactccgtcaaggacattggaattgctgatgatgttggacatgatattctgcagcgtctcgataaaatgattgataccgatcgatgactgcccgatctcatccatcgactttaccgtaacgcgctttgtgaggtcaccgtgtccacctttgatctcatcaataatctctgtcagttcactcgtctgctttctgagcggctttacaaccgtcttgataatcacaacaaccaccatgacaaatgccacaaaagaaattgccagcaggatcagcgatagtatcatattctggttgtacagatctttctgttcctgaatattctgcttcaccaattcatcgttgcgagatatgagcgtatccatattgaccgcaatcgtatctgaccactccgtcatcacagaatttgcctttgccaccgctgctgcagaatcaccggccatcgccgtctgcatcagttccacggttgtcccctgcgcctctgtgagcagatcaaatgtctcattcataagctggatatcatctgccgtaaaatagtgatccatcgccagaagctccttttcatagctgtccacgttcgactggtattccgtcagctgggatgccacatactcatacagatccttgctcggctctgcgcagagcgcaagcgtaagcttctgcgtgttggcaaaagcaagattgatctcatccatacagattgtcgcacgtacaccctctccggagatctgattgctttccttctgaacggcggtcatggaataaagactcacgcctgcaatcataatcgcgatgcacccaagaaccgcaaccggtataatgagtttggcaataaccgatgattttttcttcatcctttcgtatcctccattaaaattgtctatagccccattttatcatgatatgcggacatattctattcatttttttaacgaaatctatacattttaaaaaaatcctcgtatatcttgacatccaagttagtttgtactaacataacagttgttatggaagaagaccgaaaaaaattaaccgaaaagaaattactttcctgcggaaaacgggaatttctggaaaagggatatgcgaaggcgaacctccgctcgatctgcaaagcttccggcgtgacaaccggcgccttttacttttcttttgcgagcaaggaagcgctgcttcgcgccatcttagatcccttcatcgcagattccagagagctcctttccgggcttgcccggatggaggaggaacatcccgagactgcagacgacaatgagatccagatcatccggtatctctctgcacaccgcgaggaatgtattatcctgatggagaaatccgccggcagctgctatgaacattttcatgaggaagcagccgcgatgatgcaggaatctttccgccgttattacagaaagtatcttggcgccgaaccggatccggaactgatccggattcttgcgtccatgcgcctgcacgggtatctggaattagttcatggagactacacaatgaaagaaagactgtttttagccagagcgatcggcatccacgccgacgccggcaccctgagtttaatacaatatttaaaggaagagaatgatgctcaccgttaatccggtgggcattttcttttataaaacataacaaaaaaatatttgttatcgaggaggaaaacacaatgaatcaaaaaccaaactacggaaactgggtacctgaaaaactcttgtatctgaccttcggcggcgccgccctctttctggtgcttgcactgctggcaggtcttgctttctcaaacacgcccctcgcggtcatctgcgccattctctgcgccgttctgctcgccttcggcatctatatgtatgcgtgccacgaatgctttgcctttggaaaaggcgatatgatggcaaaggttcacgcacatctggtcgcccatctcaactgggacggacacggcacgcttctcgacatcggctgcggcgctgccccgctcaccatccgctgtgccaaggcattcccggacgcagcgctcaccggcatggattactggggcgcacagtggaactacgccaaagagcagtgtgaaaaaaatgcggcaatcgagggcgtcgcttcccgcatccattttgagaaaggcgatgcggcacacctgaactatgccgacgagacgtttgacgccgccgtcagcaactttgtcttccatgaagtccactccgccagagacaagcgtgatgtcgtgcgggaggcactgcgcatcgtaaagcgcggcggagttttttccttccaggatctcttcgcccagaaaagcctctacggcgacatggatgcctttgtggaagagctgaaaaaggaaggcatttccgagatccactacatcggaaatctggaaaaaacactggattttgtccccgcctacgtgcgcacaccctggatgatcagcggcatgggcattctctacgggaaaaaataacagttccctacagctgcgccggcacttcgccgatgtcgccgtcaatgcagatcgagcgtccgtcaagttccgtgattcctttttccattgtcatcccggcaagatacgcctcctgccgtgtaaagtacgcaccttttttgtgcccggttaccggaaagtaacctaatgaaatgaatctcgcttgcgagattctccgcgcgcgagcggttcgcaaagcgatattttccttaccgcgagctgcgcatcctctcggagcgttttttatttcataggaaggttctactttcgcacatgaatgtatcatggtatttcctatgaaacaagaaagaatcctgctttgcaggattctccgcctgcggcgggttgctctagcgacataattccactccgacgcagtgcgatcctgcccggagggctttttcattcataggatgtaatttcctatgaataaaaaaaagacatgcaggttaatacccgcatgtcttcaatgtccagtcaccgtttccggagcgcaccagcacccactgccagtcctgataaatttcgtttggattgaggcttccgtctccgccgtgcttgtccgtctgaaaatctgacagaagaacaattgcctgatctgcctgatactgatctgcccattccgactccgcttcctgcacgctctcctcatcgtaccagaaagccgtcatcacacatcccggaaaatgatcgtcgaaatactcctgcgcggtatccatcgccgcactgatctcctcctgcgaataatagtcggacgctccgatctctctcttgactccgctcctcgctccgttgccaaaacatacagcgatcactcccacaaccactgcggcgagcagcacagcacccagaatctgaaagatcctctcatactgttttgtccccatgttcttttccccttattcctgtgttctctgatagaatgtgtacacattcctatctttctatcatactctgcctgactccattcgtcaatcatccgccacagaatctttcacataaatacagaaaaaacggtcggtgccttctcctagtcaatcagatcattctgaaaacgcgacaggtgctcatacggaagaatcagccggccgcggtacagcccgcacccgtcattgatgaggctgttgtcgattgccgcaaacatattgacgtccagctttgcaagctcgagttcgtgcagtctccggcagcgctcgtaggcttcatcaaagtagacacattccccctcggggatggcgtcccttctcgcccggtcgctctcctgctttttctcataccccagatgattggcgggtccgatctctgcaatatcgtccatccgcttcgtccgaagctgcatctccatgtagcacttcgcgctgttatcaaaaaacgtaatatgcagggagcggtagccgtccgggtccacatgcgcgatataatcgcggtaatacgggcgcaccgcatccgaaagcagcggggagtcgctctccttcacacctccggcgggctccgccgtaaacccgcgctcctccagaaatcccttaagcacattggcaatctcatacagataacggatctcctcccgctctccgtcgtctggattcttaagatggcacttcggcatcgagatgacaatccggtacgcgatcagatcccggaagcagttcaagcgttcctgcaattccggcactggcggatacgttccgttcttcgtatagtagtcatagatgtactccaccacataaccgttgaacttcgcctccgcacggatcaaagacttgatccttcctttgaacgtgaaggacaggtagggatattcccgcgccatatatttataaaattcccggatcttctgcgactgtgccgtcaggaaatcattgtgctcgagcaattccataatctgcgacagaaattcacagtgcctgacatccacttcattcccggtctgcgctgcggactgccgcaggtcttcggtgtattttttcaaaatttttaagacggtgtctccggagtagagataatcgtttaatgtaatcataggcataccttctttgggtttctacctatattttcagatatattttttatctcgtcaacacctttttacagtatcggtgcgctccgcaatgcgggcataccagcttcctcctggtcagcgtgtgcggtcccataacataagcacccatctcaggcacaaaccgcgtcttacactccgggcactcataagctcctgcatcacgatcaagaatgcatgcaatcgcaatgccgatcacaatgacaactatgccaactgcaatcagcgcaatctgcatccagtcctccatcggaaaagctcccgctaccacaaacattggcgtagctgcaataatcacaagcgccgataccattccggataaaataattttcttcttgctttcctgtgcttctttcactaaattcaccatattctcctccgctttctcccgatactctgtctcggaaatccgttctcctgtcagcaattcgtttacagatagatccaattcgttacataacggcagcagcagtgaaatctccgggaaaccatttccgcgctcccattttgagatcgtcttatcactgattcccagctgctctgccagctgtctctgcgtgtaaccctttttctttctctcatctgcaataaattttcctgtcttaatctgatccatgtcttcctcctttctggtctcattatgttcccgctcccacggctttcacacacacgcagcgtagaatatggtgaatttgtgcggattctacgctccgtcgagtgcctcttgccctcggtctctcggtttcatgaccggttatcctcaactcaggcaactacagtttccttctcctgcaaccgccgatccagatcccggcagctacagtttcccactttaatgcaaaaaaggctcccaaggaaaaccctgggagtcttaaatttactgaataatatttaattactcgatgattgtagcaacacggcctgatcctacagtacgtccaccctcacggatagcaaatgtaagaccctgctccatagctaccgggtgaattaactcgatagtcatctcgatgttatcaccaggcatgcacatctctgtaccagccggaaggttgcaaacacctgttacgtctgttgttctgaagtagaactgcggacgatagttgttgaagaacggagtatgacgaccaccctcgtcctttgtcagaacgtaaacctgagctgtgaacttgtgatggcaggtaacagtacccggcttagcaagaacctgtccacgaacgatctggtcacggttgataccacgaagtaatgcaccgatgttatcaccagcctgagcctcgtctaactgcttacggaacatctcgataccggttacaacggttgtctgaacatcatccttaacaccaaggatctcaaggttatcattcagatgtaatgtacctctctcaacacgtccggtagcaactgtaccacgacctgtgattgtgaatacgtcctcgactggcataaggaatggcttatctgtgtcacgctgcggatccggaatgtactcatcaactgtatccatgagttccatgatcttgtcgccccactcgcccattggatcctcaagagccttaagagcagaaccctggatgatcgggcatccctcgaagccgtactcctcaagctgctcggtaacttccatctctactaactcgatgagctccggatcgtctaccatatcgcacttgtttaagaaaacaacgatgtaaggtacacctacctgacgggaaagtaagatgtgctcttttgtctgagccataacaccatcggtagcagctactacgaggatagcaccatccatctgagcagcaccagtgatcatgttctttacatagtcagcatgacctgggcagtcaacgtgtgcgtaatgtctcttctctgtctcgtactcgatgtgagcggtagaaattgtgataccacgctctctctcttccggagccttatcgatgttctcgaaatctgtagctgtgttaccagcaactcttgcagctaatactttggagatagctgctgttaaagttgttttaccatggtcaacgtgtccaatggtaccgatattacaatgtggttttgttctttcaaacttagcttttgccattttgaatatcctccttaaaatgatgccccttgcgggctatagttattatataagaataactcggctaactctgattatataaaataatcagcggtttttcaagctatttcttaccggatttcccctgtttatgggaaaatccgggatttttacaaactgcatacggaaagcttatttggacttgtcagccaataccttctcctgtacactcttcggtacctgctcgtacttctcgaagaacatcgagtagttaccacgaccctgtgtcttagaacgcaggtctgtagaataaccgaacatctctgcaagcggtacatatgcctttacaagcttaccgccgccgatatcatccataccctcgatacgtccacgacgggagttgatatcaccgataacatcacccatgtactcctcaggcattgtaacctcaaccttcatgatcggctcgagtaataccgggtttgccttgtgcatagcttccttgaatgccatagatccggcaatgtggaatgccatctcggaggaatcgacctcatggtaagatccatcgtatacgttcgcatgaacaccgagtaccgggaatccaccaaggatacctgcctgagcagcttcctcgataccttcgccgattgccgggatgtactccttcggaatcgcaccgccgactacggtagactcaaacttgaatgtctcttcaccgttcggatccatcgggtcaaacttcactttacagtgtccgtactgaccacgtccaccggactgctttgcatatttgtattcaacatcaaccggctttgtaaatgtctctttgtaagcaacctgaggtgcaccaacgttcgcctcaaccttgaactcacgaagcagacggtctacgatgatctccaggtggagttcacccataccagcgatgattgtctgaccagtttcctgatctgtatgagcacggaatgtaggatcctcttctgcaagttttgcaagagcctcacccatcttaccctgtccagccttggtcttcggctcgattgcgagctcgataaccggctccgggaactccatggactctaagattaccggatgctgctcatcacagatggtatcacctgtcgttgtgaacttgaatccaacggctgcagcgatatctccggagtatactttctccagctcctgacgcttgttggcatgcatctgtaagatacgtccaacacgctcttttttgtcttttgttgcgttcagtacataagaaccggagttcattgtaccggaatatacacggaagaatgcaagctttcctacaaacgggtcagccatgatcttaaatgcaagtgcggagaacggctcttcatcggaagagtgtcttactacctcattgccatctaagtcaacacccttgataggcgggatgtcggtcggagccggcatgtactcgatgattgcatcgatcagcttctgcactcccttgtttctgtaagcagatccgcagcatacaggtactgcagtacactcacaggtagcttttcttaagaccttcttcatctcctcaacggatggctcttcaccctcgaggtacatcatcataaggtcatcgtccagctcgcagatcttctctaccagctcgctgcggtaaagctctgcgtcgtccttcatatctccaagatcatcggtaacggtgatatcatcacccttatcgtcgttgtagatatatgccttcatctcgaacaggtcgatgattcccttgaaatcatcttccttgccgatcggcagctgaagaacgattgcgttcttacctaatcttgtacggatctgatcaacagcgccgtagaagttcgcacctaagatatccatcttgttgatgaatgccatacgcggtacgttgtaggtatcagcctgacgccatacattctctgactgaggctcaacaccaccctttgcacagaagacgccgacagcgccgtccagtacacggagtgaacgctctacctcaaccgtaaagtcaacgtgtcctggggtatcaatgatgttgatacgatgctccagagcacccggcttcggctttgtgaactcttccagagtccaatggcaggtcgtagcggctgatgtaatggtgatacctctctcctgctcctgctccatccagtccatggtagcagtaccctcgtgagtatcaccaatcttatagttaacaccggtatagtacagaatacgctcggtcaatgtggtcttacccgcatcgatatgagccataataccaatgtttctggttctctctaatggatattctcttccagccaaggtatttcctccctaaattagaaacggtagtgagcaaacgctttgtttgcctctgccattttgtgcatatcttctttcttcttaacggatgcacctgtgttgttagctgcatctaagatctcattagcaagtctctcttccatggtcttctcaccgcggttacgggagtatgttgtcaaccagcgaagtgctaaagcctgacgacggtctggtctgacctcgatcggcacctgataagtagcaccaccgatacgtcttgcctttacctcaagaactggcataacattgttcatggcctcttcaaatacctcgagagccggcttctcagccttctcctctactctcttgaaagctccgtatacaatcttctgtgctacacccttcttaccgtctaacatgatgttattgacaagcttggtaaccactttgttattgtacattggatctgctaatacgtctcttttctgagtatgtcctttacgtggcacggttcttccctccttaatcataatttactatacagaactctgtctgcattgcccggtctccagtctctggatccggaggacttcatttcgattaattcaacggtactcacaatgtagtggcaggtatctgcctcttcgtgttcgtgcggaaatatatctctgtgtgaaacaattccaacacttaccatgtgatactattggttcgctgaattacagtaactctacgctactattttgcagcctttggtctcttagcgccgtacttggaacgagcctgctttctgttagcgacaccggcagtatcaagtgtaccacggataatgtgatatcttgtacctggtaaatccttaacacgaccaccacggatcagaacaacgctgtgctcctgtaagttatgtccctcacccgggatatagcttgtaacctcgattccgttggaaagacgtactctggcgatctttctaagagctgagttaggtttcttaggagtagctgtcttaacagcagtacatacacctctcttctgcggagaagaagtattggttggcttcttctgtaaagagttgtaacctctctgaagtgcaggtgctgtagacttcttaacagatgtctgacgtccttttcttactaactggttaaatgttggcattattttcacctcctgttttatttgtatgagatcataaattgatctcggcgtacgtatgcacgctaaatcattatattaaccctatctttttttgtcaagttcttttccaaaatttccttgaatttcgcggaatacgtgggtaaaaaagagttctgcatgcaaaaagaaaagatggaaaactcccaacggatatcttccatctatctattcttccacatttttacatgtttataccaaacggtcagccatttgcccgttttctctgcttctcctgtctctcactggtcagaatcatatagattcccagcagcatcacaccgatgcacagaacatatttcggatttaacgactgtccggtcttcggcgtctcatcctttacctgcgagtcatccgccgcctgcgcattatccgccggctgctccgtctccgccgcttccgtcgtctctgccggctggctttccgcctggcttccgcctgccggtgtaatcacaaacccggaggttgcctgcgccgttgaatccgagtgacgctcatccactacgatgacataatcacacgcatgcacaaaggaaaatgacacattgccgtccgcatctgtatcagactgtcccatatactccaggatctgattatctacattataatagaacaaagtgcccagcttattggcgttcgccgcaccgacatttacggtcagctgcgccgtcaggccaaacaggttgtcgtgcgccagatgcatctgcgttgaccatccgcttccggttactgtgctctgcaggttcgccggcacattgcttgttcccagttccacgccaaaatccgtatctgctacaacgcttgtgtcaatgctgcttccgtcaatcgtccatgagattccatttcccatatccagaaccagcgtcagctgcttatctgccgccagtgtcagaatatccttcggcacaaccgtggtgccgttcatggtaatatagatcgttgaacctggatccgccaccgtcatctgcgtgtaaatcgcatcccagcccttcagttcctcatttccggtgatatatgcggttccctgctctgcaaatctggtcgtcgcaggcacttccgccgctgtcggctgcacatctccctgtgtctccgccgtcgtcgctgccgccgatccggtaccgctgctctgtgcgcctgccgctccggcactgccctttaccgcaccgctgcctcttccactgccgttgccgcttctgctgcctcttccagatgatgtgccgttactctttccgctgctgccgcttccgctgcccgtactgctgctgttattaccactgctcgtgttgctgctgttattgctgctattgttattactgctgttattgttattgctgttgtcgccgctgttattgttgttaccgctgttattattgtcgttgttattgttgttattgttgttattgttgttattgttgttattgtcatctgccggtttttccgtgtcctcggtcggcttctccgtatcctccgtcggcttttctgtatcctcggtcggtttctccgtgtcttccgtcggcttttccgtgtcctcggtcggtttctccgtatcctcggtgtcgtccggcttataatccgtcaccacaatcgcaccgtacgtctccaccagcttcggtgcagccggagcgcttcccggcacttcaatcgagtggatcttgaaagaagtattctgctcgccaaacgtttctaaggctttgccaaggcagagtgtctgaatctcactgccgtcaaacgcaccatcttccacggttgtcacgctctccggaagtgtgacttttccaagcttgcagccgtaaaatgcattttcaccgatcatcttggtaccgtcatacacctcgatggttctcgccccctgcgggcagcggtataacgtaaccccgttcgccgtgtagagtgcattgtcgtatgacataaagtaagtattcgtctcttccacgtcaatggactgcatgttgacacatccgtcaaatgcgtccgacgcaatggttttggtcgcctcgggtatcacgatactctcgagggactcacaatttttaaatgcttcttttccgatcgatggaagttccttggaaatacttaagtccgtcagtcccgcacactctgcaaatgtgccatcgccgattccttccttgctctcccacgttgcactttccagactggtacagccgtagaacacattgtctccgatctttgtcacgctgtccggaaccgtaacctcggtcagatattcacatcctgcaaatgcgttatctccgatggttgtcacactgtccgggatctccaccgatgtgatcgtcgtattgaggaatacatcgtcatcaattttcgtgatgttatccggaatgacaactgcgttctccgctccgacatacccctgcagggttgtcccttttatgacaaatccgtcctcctgaccggacgctgcactgagctctccgggatagatcatcaccacaagcatggcaacgaccagcacataacctatttttcgttttatccggtatttcattagcactctctcccatcatcctttatttcgccgcagcccgcccgtaaacctcacgcgcgatcccacgcttttactctgcttccctgcatttcttcgccaccagaaacagtcttccgtcttctgtaaaattgttacaggtcgacagggtcaatagctcgtccccgtagaccggcagatctgttccggtaaacaccgagagttgtatgatatgatcgaggtagtcgttaaacgcctcctcggaatccgcctgtataaaatcataataacgaaattcctgtgaatttcggtactgcacctttgccagacagacggcaaacacttcataggtgcctttctcataaattgtatcaaatctgatctgcgcgtgctccctccagtaatcttcatccagatacttcttgagacttccgaacatcgcaccgcttttcatgttgtgtccgtagataataatattggtgctgcgctgcaccagatccgttctcggatccataaacaaggttccgttgatatcgtcctccccgtttacattgcgcttgagataataatccccgtcattcggggtaagcatgaccggatagtcaatcttcgtcccgtcaatggtgatccatccggcaaaatcactgtgctgcgccacgatggcttcatattccggcagaaccggaggaggcggttcgttctcccgctccgtctggtctaatcccgccgcaagttccggtgcatcctccgaaaaaaaggtgtcattgtccaccatctctgcggcttctgtcggattttcttttagcatcttcaaatactcattcgcctgactgccgcggtgattcgtgtaatctgaccagaaataccagccaaaacatagaatcgcagccgtcacacacaccgcaccgagaatctttctgctgcggtcctgcgccacctgccggggttcctcccccgcttgttgttccggcgcctgtgcctgcgttatattttttgccgcggattttgccacgacatctgcaatatccagaaaaaatttcttgccgactttgctgccgaacttgatcttccctgttcggatcagccaatagaggcgtagagcggtttccggttcattgagatcgacggtgttctgtatcttttcgattttcttcgcatcttcgagccctcgggcatattcctcttctgtgtcaaatgtaaaattccctatcttatatgccgccatgatcggaaccgctctccctcctctctatctttattttgtggttgttccggtaactgctccggtaaactcaccgtagtaagtctcgccgtccgccaccaggtagcttcttactttataagagtatgttgtctctgccgcaagctttttatcggtatagaaagcgtctctggtacgcgttacctgctgccactttccatctgcgccggcacggtatacttcgtatcccgtcacggcaccgtcgcccgtccagctgatggacagactgtctgcggatgcgcctgtcacaaccgccgcgcccgcatcgcacggtctgatgtcaaacgtcaggttctttgtcgcggtgtaattgccttttcctgcaactgccgccacaccggtacctgccttgcggttgttggaatacatcagtgtgtagtcgcttaaaagttccagggctttgccgtcatcttccaccgtcacggtcggcttgatgtcagatccggtatatacctgtgtctgaatcgaaccaatgtcgcacagatgtatgctcttgcgcagaatctggaaactcagttccttagtacctgcataatgggttccgcttgctgtgattaccagcttcgctacacccgcgttgatgttgtcttcataggataccgtgtaatccttatctttttccagctgcacaccgtctgcccatacttccggctccggtgtgattgcttttccggtatatgtgtaagtagaagaaatacccttcacttccagtccgtcgatcggcgtctggtctacagtaaactgctttgtaacggttcctgtatagttgccggttccggcaacctccatttcgtagattcctgccactcctgccggtctgcatgtcacggtataatcggtgtctcttacgagtgcgatctcaccccactggaatgttacattctgtgtaatctgctctgagtaggataccgtgtcctcaaatccgctcatcaccacatcttcatcggtgatgtccttcggtgtaatctcgatggtgcatttcttggttccgccatagcttccctgaccgatcagaagaagggtctgcgttccggcgctcatgccatcgctgttgttgtcaaatgcaaagctgtaggagtctgttgtcagaaccgtctcgccgatgcgtacctctgtaatgcccagatcatccggcgtataaacgcttcccgtgaacgggtaactgtcacgcagtcctacaatctccgccggactgatgtcgctcgcaatatgaaatgtggtctggcggtaattcgtaaatccgccggttccgttgatccgcatcagcacagtgccgatctctgtgttgtccgtgtcaaagctcagtgtatagtcctcaccctgctttaaggtgtaatcgccgcaggtcactttgacttccggaatcaccggctgacctgtgtatgcctgattcggaatcggatccaccgtaacatccgcagctgcaatatcgtggcttacgatggtaaacggtgccgttacgcttcccgcatagcttccttttcctgtcacggtcacagttgcggtaccgcacgccttgttgttctgataagatacctcataatccgtacccgctgtgagtacattgccgtccagtgttacctgcacttccggttccaccccgttgtcgcttcccatatacggataggaagttccgttcgggaacgtgacaatcgctccgtcaaagctcttctccgtaatcgtgtattccacggtgcgggatcccgtataatttccgataccggaaatcaccgctgtcgctgttcctgcatggatattgttgctgtatgcaacggtaaaatcgcttccctctgtcagctgacgtacctcaacctctgttccgtactgatatgtcacaagaacagtcggcttcttttccgttccgtcataagaaaagctgtccggaatcacttctaccgcaatcaggtcggtgccggatgacggttttgccaatgatttcgccacgatctggaaggatacttcacggcttccgattacgttgcttccatcaccggtaatcacgactgtaccggttcctacattcgtattatccgcgtctgccttctttgcaatggtatagcttcttgccggcagaatgtaatccgttgatccgatggttgtcttcaatgagaactccggcacaatctccttaccggtgtactctctgcttccgatcgcgttctgcgttccgtcaagcaccttcaggtcgtccatctgaagtgggttaatatcaaaggttaccagcttgatcagaccagcatactcgttcttaccctttaccataatgcttccgccgtctgttcccgccttgatattctctccataggtcacatcataatcggacgtggacagtgtcttgttccctatcttaacggtaacctgcgggcggatctgtgttccgcggtacaggtagctgctctctacaccgcttacctccagaattcccgcatttgcaacaatgctgaaattctctgtgagtgttccggtaaatccgtttttctcatttccgattaccgtcacgctcgcagtcttatcaccgatcttcacgttgttttcgtatgtatgaatcacaaagtgctttccggatgtcagctctgttccgtagtagctgatgctcgggattgcctccaccggatctccggtatactgctgatctccgattgccacctggatgcctgcctccgaaagatccgctttgatcggaaccgtcttctccacgcttcccgcaaagcctcccatacccttgatggtaactactgcgttgccgacccagctgttgtctgcatagaccagcgtatagtcggtatctttctgaagtgttgttccgttcagcacaacactgatctgatcgtcaaacgtgatgttcttatcgccgattgcaatgtccgtctctccggcattcacataatctttaaaccacagttcatccggaacggtaatctcggcgtccgcaatgtttgcgcagatcttaaaggtcttcttcacgcttcctgtgtaattgccgattcccttgagaatgacaaccgcgtcggagccaatgctgtcgttcttctcataagtacaaatataatccgtacccatgacaagttctgttccgttatagtacagcttcggctgcggtgttgccgttccgtccaccagcggctgcggttcgatcgctccgatcttaaagccgtttgccggtgtatatccgccattgccaatacttgcaagtgtgatcgtaaaggttgtgcttctcgatcctgtaaagtccgtaccgtcctttgccgttgccgtcagcgtcacggttccgcggctggtatgatccgccccgtaggataccgtgtaatccgtcgtgctgatcttctgtccgtcataagtaagcttcacttcaggctctaccgggcttccggtatactgtgtctgataacttccatcggtcactccgccgacagagagctctacgctgctgtccgtaagatctctcggtgcaatcgcaaaagtcttctgccatacaccgacgtatcctcccagaccttccacgcttaccgttgcggttcccgcgtggatattatccgtatatgtcacggaatagttagaatcttttaccagctttttgttgccctcgatccgtgttaccgtcacctccggctcaaatgcacttccgtcataaacatactgtgtgccgtcggtgagtgccgggcagctgatcgtaaatttgctctcgtttgtgatgagctggccaattctgaattctgccgtcttgcttccggtaaagttgccggttccggtcactgtcaccgttgcggttccggttcctttgttgttcgcgtaagccaccgtgtaatcgttgaccgggcttaacgcataggttccgtctccaaattcatagcttaccgacggtgccggtgtgacagccattccgttgtactcctgcgcgtcgatcggtgcgatctttacctccggctctgccagattcttcggcgcaatcgtataatctatcgtaaaggttccctgatagtttccttttccggtaatcgtcatcgttgcggtcccggcatccacattattctcgtaggaaatcttgtaatcatcctcgccgagctttttcttcagatctgtgcactgtaccgtaggtaccggtgtaatctcttccgaagtgtatgtatagctggactttaatccgccaagcgtgcagttgttgtccaggcttctcggcagaatcgcaaatgtcaatattctgtcatctgttccgtagtaatctcccttaccggaaacggtgatggatgcctcgccggcattcaggttgtccgcgtaggaagactcgtcatacgcgatcactttctcgatctcatcggctgtcgtaagctttgttccatcgctcagcgtcagctcggtgatcttcggatacagacgctcgccggtgtaggtcgtctcgttctcatccaccttccagctgatgatctcgtccagggattttccgctgatggtgaatacaataatcttcgttcctgtgtagttgccgttaccctgtatggtcacatttgccatcggtcccggtttctcgttgttcgcgtagctgccagccacgatcgaatagtcggtcggcgcagtcaatgtcttcttattataagtaagctttatctcactttctgtaagggtcactgcatttccgtcgtacgctttcttgatcgcctcgtaggaaacaccggttgcaatgtccttcggacgaatcgtaaaggttgcactcagttttgtggcgccgtcgctgtacacatagcatccgtttgccgtcggctgatcctccagcgggatctgctctactgtaaccgtcgcctccccggcattgatcgcctgatccgcgttggttccgtcactgtagttgaccgtataatctgttccctgctcaaggacgctcttccagagtccgaatccgccgtccgataccgaaatctcatccgcagcaagcgtaatcggatctcctgtgtataccgggttttctgccggattcaccgatacatcataatcctcatcaagcttggatgcgagcagatacttgatctcctgcttgccatagaatttgccctttccggtaatcgttaccgaagcagtgcttccttcttttgaaatatccttgatgccgtcatactttaattcgtaatcagttccttttaccagcgtattgccctggttatccgtgagtgaaatctcaagctggttatcgtttttattgttggaataccacagcattgcccagtatggtccgtcatatcctgtcaccatcctgtccgtgctgttggttaccttaaggttcttgtcgttgatcagtgtctggatatctaccgctgtaacctcaaacgtcttggtaacaacgcctgtatagttgccgcttccggtaatcgtcatcgtgtaggttccgatgtcttttaccgttgtcggtgaacatgccaccgtataatcggttccctttttcagtgtatgatctgtctttgatgcggaatgatatacaacactctctgtcggaagcgcaatctctgctcccgtatagtcaaacagctctctgtcaatgctggcagtaatcttcgtgcttgtaagattgcactgggcaatcgtatacgtcagacgtttcgttgtaccggtcttaaaattgctgttggaatcgctcggcgcaatctcaacgctcgccgtacctgcaaatatcttggtatccgcagaataggtcagcttgtagtccgactccggaagtgttaccatgtccgcgccctgcgcaaactttacaaccaccttcggcttcacgtctgctccgtccggagaatattccatcttatagtttgcagtgcttacctcggagccatcggcatccacatagtagcataccgcctttgacatgtccgcctgctcgattgtgaatttaccggtcactgcaccgccgtatgttcccataccctgcagcgtaatggttgctgttcctgcattcgtgttgcttgcgtaagtaacggagtaatccgttccctcaaccagtcccagatcgttgttgccgctcttccaggtaatgtccggttccggtgtctgtgcattgccgttataagttacagccgctgccgtcactttctggatcaggtctgagagatcagcgcctgccgcctgatactccaccgtgtaggttccctgatagtttccgataccggtgatgacacgacggtaggttccgtttccggcattgataatatctgttccgacggtgtaatccgtccccttctccagcgtcatgccgttgtaggttgcagtgatgaccggctccttgtccgctcctcctgccgcagcagccgtcacagacacagccatgccaacttcttcctgatccttgttgccaatatcttttgccttgatctcaaaatttaccgtctttgttccgtaaagggaattttttccggtaatcgtcaatgtggcttgtccgacattgacattgtcggaatataccgcatcgtaatccgcctgggaaatggtctccccgtccaccagaagctggaatgccggtgtccactcacttccggtatatacataggaagtcttgtcaaaaacaacattcgcgtccgccgcattgcgcggtgcaccgcaatatctctctccggtatagttgccggtaccagtcagtgtaattcctcttcctgtcttgctgagggaaatcgtgtaatctgttccttcaaccagattcttcacgccgtctacggcatccgcatctgcacgcgccgtatcctttacctcttggatacaggaggtaagtgtggcagaagcgttgtccggatctgctgccgcatcagccagcaccttatcccagtcaatattgtcctgcagtgtcacttccaccgtcgcgtctgatacgtctttctgtgcaatcacgtattccttctgaatctttccgctgtaaccgttctgtccggtaatgtacaggtaataggttcccgcattcacaagcacggtcgcatccgtagccgggtcaaaagttgtcgccgcaccgccaaccatctgtgcataggaaagctggtactgatcgttctcttttaatatggtatctcccacctgtaccgcaacggatggaatctgctgtccgccgttgtataccggattctccgggctgactgtcaccgcatcctccgaaagattcggtgtgaccgtcagattacaggtgtagctttttcctgcataggttgccgtgatcgtcgtgctgcctacggcaataccttcgatggttgccgggttgcccgtactgcttacttttgccaccgtttcattgccggaaacccatgttaccgttcccgtggcattctgcagtgtaagatcctgatccgtccatccctcaccgatggtcatgctgttcttgttcagtgctgcggcagcactcttcttcacattgctgctctgtgccgccgtctgattatccgaaccggaagaacttcttccggttgtagcagttacatcataggtgtatgcagttatcgccgcactgcttccgttcactgtatacatatcctgccagccggcattgccgagaatatagctctctccctctgccgtaccgccatatacataaaaggacgctccgttcaaccggacgatcacagaaaacctggaaccattctccattacctgattcgccagccctgcggaataagtattctttccttccttcacgctgacttctttttggaaaatgctcgttcccgcatccggcgccatgccttctacatccttgtaatattccacggtagccgttgccttgctgccgtcatccacatgtgcgtagaagtcaatactgtctaacagttctgctccgtccgcattgcggtccgctgtaaataccgcagctacagcctgggcctcgcacggcgctcccgccagtaccccgtctccgttccgataggtgtttaccgttccctgtcctgcccagacagtcgtcggccattccaccatcgtcacaatcaggcatactgtcagcataaacgccgaaattctcttgcatacatccttgtacatacgcgccatctcctttgatctatccctttagcgttcgtcccattttatgaaactctaaattataccttatctattttatcgacatcttttcacggttctttaacatcttttcaaaaaaaacgaggcagccatacattatctggccgccccattctgtaatgcagatataatctgcgctttattcttctgtatcctcggactcttccggcgcattctcctctaatgtgtaattctcatctgccacatcagtgtcatcaaaatcgtcgaaatcatcgaatgcaatctcctcgttctcatcaatatccgagctcagcttgatattgcggtatctcttcataccggtaccagccgggatcagcttaccaatgataacgttctccttcataccaatgagcggatcaaccttacccttgatggcagcttccgtcagaacctttgtggtctcctggaaggatgctgctgacaggaaggagttggttgcaagagaagcctttgtgataccaagcagtacctgcttgccttctgcaagctccttgccctctttctccagaagctcatttgtatcctcgaagtcaagcgtatctactaatgttcccgggagcatatcggaatctccgtttgtctccacacggactttctgcagcatctggcgcacgatcacctcgatatgcttatcgttgatctcaacaccctgcagacggtatacacgctgtacttcgcgaagcatgtaatcctgaacggcacgcacacccttgatctttaagatatcatgcgggttgacagaaccttctgtcagctcgtcgccggcctctaagactgcaccgtccataaccttgattctggaaccgtaaggaatcagatatgccttgctctctccagtctcattgttcgtcacaacgatctcacgcttcttcttggtatctttgatattggcaacaccgctgaactcggtaatgatcgcaagtcccttcggctttcttgcctcaaaaatttcctcgacacgcggaagaccctgtgtaatatcggtaccggcaacaccacccgtatggaacgtacgcatggtaagctgtgtaccaggctcaccgatggactgtgccgcgatgataccgattgcctcaccaacctgtactgcctggccggttgccatgttggcaccgtagcacttcgcacacacacccatgtgggaacggcaggataatacagtacggatcttcacctttgtaagcggttctccgttctcatccacacccttgctcataacaagcgctgcgcgcttcggtgtaatcatatgatttgccttcacgaggacattgccctcggcatcgcagatggtattgcaggagaaacgtcctgtaatacgctcctgaaggctctcgatctcttccttgccatccatgaatgcagttacccacataccagggatctctctgcctgttccctcacagcagtcagactcacgaacgatcatatgctgtgatacatctaccagacgtctggtcaggtatccggaatcggcggtacgaagggcggtatcggacataccttttcgcgctccatgcgcagacatgaagtattccagtacgtcaagaccttcacggaagttggacttgattggcagctcgattgttctaccggttgtatctgccataagtcctcgcataccagcaagctgtttgatctgcttatcggaaccacgggctccggaatccgccatcatgaagatgttgttgtacttatccagtccggagagaagtgcatgtgtcagctgctcatccgtctctttccatgtctctacgacttccttgtaacgctcttcctctgtgataagaccacgcttatactgctttgtaatgcggtctacggtatcctgggcgtccttgatcatctgtggcttttccggcggctcggtcatatcggaaatggatacggtcattgccgccctggtggagtatttgtaacccatcgccttaacagcatccagcacctcggcagttctggttgcgccgtgaatattgatgactttctcaaggatctgcttattctgcttctttgctacgaggaaatcgacctcgagctttaattcattgcccggaatgcttctgtctacaaagcccagatcctgcgggataatctcgttgaagatgaaacgtcccagcgtggactctacgattccggtaatcttttttccatccggcatggtcttgctcatgcggactttgattctggagtgaagtgttaccgcgccattctcataggcgaggattgcttcgttgacactcttgaagaatttgccttctccctttgcgcctggtctctcctgtgtcaggtagtaaataccaagcaccatatcctgtgaaggaacggctaccagtccaccgtcagacggctttaacaggttgttcggagagagcagcatgaaacggcactctgcctgcgcttccacagaaagcggaagatgaacagccatctggtcaccatcgaaatcggcgttgaacgcggtacacacaagcggatgaagcttgattgccttaccctctacgaggatcggctcgaatgcctgaataccgagacggtgcagtgtaggagcacggttcagcataaccggatgctctttgatgacgtcctcgagcacatcccagacctcagtctgaagtctctcgaccatcttcttcgcactcttgatattatgagcggttccgtttgcaacgagctccttcataacgaacggcttgaacagctcgattgccatttccttcggaagaccgcactggtaaatctttaacttcggctctacgcagataacggaacgtccggaatagtcaacacgcttaccaagcaggttctgacggaaacgtccggacttaccttttaacatgtcagacagagacttgagtgctctgttacccggtcctgtaacaggacgtccgcggcggccgttatcgatcagggcatctacagcctcctgaagcatacgcttctcgttgcggacgatgatatccggtgcgccaagctctaagagtcttctcagacggttgttacggttgatgattcttctgtacagatcatttaagtcggatgttgcaaaacgtccgccatccagctgtaccatcgggcgcagatctggcggaatgaccgggatgaccgtgaggatcatccactccggcttgttgccggactcgcggaatgcttctacaacttccagtctcttgatgatgcgcgcgcgcttctgaccggttgcgtctgcaagctctgcctgaagctctgcggaatccttctcaagatcgatcgcgtgtaacagttcctggattgcctcggcacccattccgacacggaacgcattgccgtactgctctctggcttcctgatattcgctctcggaaagcacctgcttatactgtaatgccgtgttaccggcatccagtacaatgtatgatgcaaaatataataccttctcaagagttctcggtgagaggtcaagaatcagtcccatgcgggacggaattcccttaaagtaccagatatgggaaaccggagctgcaagctcgatatgtcccatacgctctctacgaacgcttgcttttgtaatctcaacgccgcatcggtcacataccacacctttgtagcggatcttcttgtatttaccacagtggcattcccagtccttgctcggtccgaaaatcttttcacagaacagaccatccttctcaggctttaatgttctgtagttgatcgtctcaggcttcttaacctcgcctctggaccactcatgaatcttctccggtgatgccaaaccgatcttaatggcatcgaaagagatagactggcctgttgcctctttattcattgtctctggcatttatgacactcccttctatctattcttcgtcaagaacgtcgtctgatgactcatcaaaaaactcagaatcgtcttcatcctcttcctcatcttctacgtctaccagttcctcgttctctgtatcaaactgcttctgggagaatcccatctttgcaaaggactcgctgtcttcaaatgcaaaatccttatcgccggaaatgatagaattcaaatcggtattaccgtactcactggtctccatgagttctacttcgttgcggttctcatcgagcactttgacatccagtccgagggactgcagctcttttaagagaaccttgaaggactccggaatacccggctcagggatattatcacccttgatgatcgcctcgtaagtcttcacacgtccgaccacgtcatcggacttcactgtcagaatctcctgtaaggtataagatgcaccgtaagcctcgagtgcccatacctccatctctccgaaacgctgtccaccgaactgtgccttaccacctaacggctgctgcgttactaaggagtaaggaccggtagaacgtgcatggatcttatcgtctaccaggtgatgcagcttcaggtaatgcatgtgtccgattgtaaccggtgaatcaaacggctctccggtacgtccgtcacgaagctgtacctttccgtcacgggaaatcggcacgcccttccacagtgccctgtgtgcgcggttgtcatacaggtacttcatgacttcctcgttcagtgtgtctttatattttgcttcaaagtcttcccactcgaagttgacgtaatcattggcaagctccagcgtatcctggatatcaatctccttcgcaccgtcgaataccggtgtctcgatgttgaagccaagtgccttcgcagcaaggcttaagtgaatctcgaggacctgaccgatgttcatacgggacggcacacccaacgggttcagcacgatgtcaagcgggcggccattcggaaggaacggcatatcctctaccggaagtacacgggaaacgacacccttgttaccgtgacgacctgccatcttatcaccgacggagatctttctcttctgtgcaatgtaaatgcggactgcctgattcacgcccggagacagctcgtcgccgttctctcttgtgaatacctttgcatccacgatgataccgtactcgccgtgcggcaccttcaaggaagtgtcacgcacttctcttgccttctcgccgaagattgcgcggagcagcctctcctcggctgtcagctcagtctctcccttcggagttacctttccgactaagatatcaccggcgcgaacctccgcaccgatacggataatacctctctcatcgagatccttcaacgcgtcgtcgccgacacccggaacatctctcgtgatctcttccggtccgagcttcgtgtcacgcgcttctgcttcatactcctcaatatggatagatgtataaacatcatcctgtaccagacgctcgctcaaaagaacggcatcctcgtagttgtaaccttcccaggtcatgaatccgatcagcgggttcttaccgagtgccagctcaccgtttgcggtggaaggaccatctgcgatcacttcgccaacctccacgcggtcgcccttaaacacgatcggcttctggttgtagcagttggactggttacttctggagaacttcgtcagcttgtatatatctctgccgccctcgtcattcttgatgatgatctggttggactcagagctctcaacaacaccggcttttttcgccacaacacacacaccggagtctaccgctgccttcgtctccataccggtaccgactaccggcgcctctgtggtcagaagcggcactgcctgacgctgcatgttggatcccatgagtgcacggtttgcatcgtcgttctgcaggaacggaatggatgcggtagcgacggaaaacaccatcttcggggagacgtccatgtaatcaaacatggtcttctcatattcctgtgtctcatccagataacgaccggatacggaattacggacgaaatgtccttcctcatccagcgcctcattcgcctgtgctacatggtagttatcctcttcgtctgcggtcatgtagacaacttcgtctgtgacacgcggattcttaggatcggatttatcgatcttacggtacggagcctcaataaatccgtactcgttgattcttgcatagcttgccagagagttgatcagaccgatgttcggtccctcaggcgtctcgatcgggcacattcttccatagtgggagtaatgtacatctcgcacctcgaatcctgcacggtctctggacagaccgcccggtcccaatgcggaaagacgtctcttgtgtgtcagctctgacagcgggttgttctgatccataaactgggacagctgggaagatccgaagaactcttttacagctgcggttaccggcttaatgttgatcaggctctgcggggaaataccgtccagatccagggtggtcattctctcacgaaccactctctccagtctggaaagaccgatacggtactggttctgtaacagttctccgaccgcacggatacgtctattgcccagatgatcgatatcgtcatcatgaccaatgccgtactctaaatgcatgttatagttgatggacgcaaaaatatcatccttggtgatatgcttcggaatcaggtcatgcacattcttgtgaatggcctcttttaaatcctccacgtccggatattcatccatgagctgctttaataccggatagtacacgagctctgtgatgccgagatccttcgggttgcagtccacataatgtctcagatctaccatcatggaagacagcaccttgatatttctggtctcgccctgaatccatacatacggaacagccgcgttctgaatatcatccgccagggatcttgtcacttcggttcctgcctcggcgatgatctcacctgtggacacatcgacaacatcctctgccagaacatgtccgttgatacggttgcgcaacattaacttcttattaaacttatagcgtccgacctttgcaagatcatatcttctcgggtcaaaaaacatagcagaaataaggctctccgcactctcaactgtcagcggctcgcctggtctgattttcttatataattccagaagtccctcttcgtagttggttgccacgtccttgccgaaacttgcaagaatcttcggctcctcaccgaacaggtctacgatctcctggttgcttccgacgccaagtgcacggatcaataccgtgatcggcacctttctggttctatctacacggacataaaatacgtcattggagtctgtctcatactctaaccacgcaccacggttagggatgacagtacaggaatacagctttttacccactttatcgtgagcgattccatagtagatacccggggaacgcaccagctggctgacgataacacgctctgcgccgttgatcacgaaagtaccggtctctgtcatcaaaggaaggtcgcccatgaaaatctcatgctcattgatctcgtcagtctccttgttgtgaagtctgaccttgaccttcaaaggtgccgcataagttgcatctctttctttgcactccggaattgtgtactttacatcgtcctcacacaacgtaaaatctacaaactccaggctcagatgaccgctgtaatcagcgattggagagatatcatcgaaaacttctttcaggccctcgcttaagaaccactgataggagtctttctggacttctatcagattcggcatttccaatacctctttctgtctcgagtaactcatacgtatgccctttccagctttcactggacgtattctgtttttctccattgacgtttcacctctcgtttttatttacactaagctgccccaaaagtggcagcaactgtctcaatccaccgtaaccacaagatacggtataggcacatccggcggcatacaacgcgaaaagcgcgcaataagcccaatgcaccacaatagtgcaacgtatatgatagcacaatagcaagtgccgcgtcaaggattttttaaaatatttatttcttctccgtgagtacgcaaaaaacgacgaaggaaagctctaaagccttcgctccgccgttcgccaccgcttatgagacaagaaaatttgccgccgcgcgggttctctgttccatctgttttttctgcataaaaaatgcatattgctgcagggtctgcttctttttctgttcggataccgcctgtccgtaatccagatcctcgagccggctttttcctgccgttacattcagcctggtgttggtactgtagcggtatgcatactccagtgcattgctctgtgcgcccataccgctgcgccctgcactcactctggcaagtgcatcatccacctgcgtcagatcaaaatctttcgtcacatcaaaatccgcaatcccaagtgcctgtaatgtggcatctgcagtcgtaatcttcattccgttgccggtggcatccgtcatgatattgtacttctgcgacgtgccatccagaagcggcttcgtgttaaagcttgtctgttttgcaatatctgaaatgccctgcttatactgctcgatctgcgcctgaatacttgtccgctccgcatctgtgatcgtcaccgtattggacgcccgaacaccaagttcacggatcttctgaagataatccgtaatcccgctcattgcgccatccgccacattcagcatatcttttgccgcgccaatgttgttctccccgaccttatagcttctggtctgcgtctcctgcttctggatgatcgcaagctccgccgcaccgtctgccgcccggttcacttttttgccgcttgcaaatttcccgtaatctgcataagatgtgctgcttcgctgcatcgaagtaataccgttcataaaagcctcctttctgttctcaagttccgctgctcttcctgtccgccttttctattttctttataacacacaataccgctactcttcaagtatctcctgaatgtaataccggctttgttttgcgagatcgacaaaagtgtcccccacctgcacaagcggacatgacagcttatatttgttaatcatgaccactcttcccatcctgccatcattcaggatcacgttgcgctggatcatcgtctcggcaatccgcttcagaaatgtcatcagatagttggcgtccagacggttatacccctcatcctccatcttcttgatcgcttcaaatgccgagatgcccgctttatctccctgacgcatcgtaagggcatcgtaagtatctgccaccgcaagaattctggaaatccagttgatgttatcccccattacctgcagtgggaacccgcttccattcacgcgctcgtggtgcgtcagaaccgcctgtttaatccgctggtctatgttcatcttcttaataaggttgtatccgctcacgacatgtttctcatatcgttccgtctcgtattcttgcagaaattccgtctgttcctgcccgtccttccagagttcaagaaatccaatgtcatgaagcagccccgccgccatgacctcctccatctccgcctcggcgcatccgctccaccgtgcaagaagctgtccaaaaagcgccacgttaatggtatgtgcgtacagacctgactgctgttttttcatatgaagcagcatgtccgcaagatctgtatcatcatctgcttttttcagcagtccgttcagcggctccagcagcatggaaatgttcacatccttactccggtatacaatatctttcagttcttccgaaatcgactgttcggcaaccgagaactctgcctggaactctttcagatgctgttccttcgccggcgcactctgttcctgctgttccgggcgttctttcctgcccgtcggatattccaccatcacactgtccacaaaatgtctggtcagcagcgcgacgacgtccttcgtgacgaccgctccgtccggcacaatcaccgcccctgtctttgaaaacacatcctcttttatcatcattccctcccgcaggcggttgaccgacatcctcaaacacggcatggtatcttctcctctttcccgtactttcatcctctggaaaagtactattttcctataaagtctgttagtactatcatataccaagtattttcttttgggaagtagggaatttattttcccgtagcggctgtcgccgcgcataagcaaaaacggcgcgaccgccgggaataaattcccgtagtcacgccgtttccgcttatatgcttctcgtagcttacgcgattattttaaagtaacctttgcgccctcagcctcaagtttagccttgatgtcgtcagcggttgccttgtcagcagcctctttgagaaccttaggagctccatcaacgagatccttagcttcctttaagcctaagccagttgcctcacgaacaaccttgataaccttaaccttgttcgggccaacctctgttaactcaacgtcgaactcagtcttctcttctgctgctgcgccgtcaccagcacctgctgctgcaactacaacgcctgctgctgcagatacgccgaactcttcctcgcaagcctttactaagtcgtttaactctaatacgcttaactctttgatagcatcaataaattctgctgttgtcatctttgccatgattattttcctccatttaatattgagattgtatcacgatgatacgttttctgcctgcagatccctgcggcttttttcactacattcgatccggattattctgccggagtctctgctgcttctgctgcaggagcttcctctgccggagcagcctctactgccgcgtcagctgcaccgcccttttctgcgatctgattaagaacgcgggcaagattggtaatcggagactgtaagcttccaagtaacttggaaagaagaacttctcttgacggaatcgaagagattgccttcatgcctgcctcgtcatagaagttaccctcaactacgcctgcttttacttcaagagccggagctttcttagcgaaatctgctaatactcttgccggagctgttgcgtctgtcgtagaaattgcgaatgcattcggtccctcaagaacgtctcttaagctctcgaactgtgttccctctacggcacggcttactaatgtgttcttatatactttataagtaacaccagcttctcttaatgctttacgtaactgagtatcctctgcaacggtaagtccgcggtaatcaacgactacaacagactgcgcatctttgatgttttcagaaatttcctgtacgataggctgttttaattctacctttgccacgaatcgtgcacctcctttttagattttacgcatataacaaatccgaaaggatataaaaatccctctctgcctggacagagagggatcagaatctcattctcaatgattgctcatgaaagtccctcggcaggctctatgattacgccttgcggcacctgctgtcttcggccattatatgcaatccacagatgtggatctgccactgctgtggcatctgtctcatgtgagacgactgcatccgtacggacgcaccgcgttacaacgcttctgcattataacactgtatattgcggctgtcaacacttttcgccaacaacacaaactagtttgtgatcttggttacgtttaacttaacgccaggtcccatggtagatgtaagagttgcgctctttacatactgaccttttaagctggacggtttcgctttgttgatagcacccataagggtctggaagttgtcgcttaactgctcctcagtgaaagaagcttttcctactggcacgtggataatgttggtcttgtccaatctgtactcaatcttaccagctttgatgtcgttgatagccttggtaacatccattgtaacagttccagccttcgggttcggcattaagcccttcggtccaagtacacgaccgagacgtccaacaacgcccatcatgtcaggtgtagcaacgatcacatcaaagtctaaccaaccctcgttctggatcttcggaactaactcctcgcctccaacgtagtcagcgcctgctgcctgtgcctcatctaactttacgccctttgcgaatactaaaacttttacagtcttacctgttccgtgcggcagtacaactgcgccacggatctgctgctctgcatgacgtccatcacaaccggtcttaatatgaagctcgattgtctcatcaaacttcgctgtagcgttcttttttactaagctgattgcctcagcaacatcgtactgattcgccttgtcaaaagactttacagcgtcctgatatttctttcctcttttcatgaatataaacctcctggtggtagtatcgggagaggaccctcccactatatcgttccataagaacaccgccggtgctctctgatgcattacactctcgtgtcttactgctctacgttaacgcccatacttcttgcagttcctgcgatcatgctcatagctgcctctaaggatgctgcgtttaagtctggcatctttaactctgcgatctcctgtaattttgccttggagagagttgcaaccttatccttgttcggtgtggaagaaccggacttgatgttgcaagccttcttgatcagtaccggagcaggcggagtctttgtaacgaagctgaagcttctgtctgcgtatacagtgattactacagggatgattaaatcgccctgatccgctgttctggcgttgaactgctttgtaaactcaacaatgttcacaccgtgctgtccaagtgcaggtccgactggaggagctggtgtagccttgccagcaggaatctgcaatttgatatatccttctactttctttgccattggaattgcctccttaattcattctttcctgattaggattgctcgcttaatttgcaagctttacatctgcgaaacttatttctaccggcgtttcgcggccgaaaagctcaacattgatggtcacgctctgcttgccaggattcatcgcctgaatcacgccgatggtatctttccagactcctccggtgacaactacggtgtctccctcagcaaaatcaacctcaatgttctctgtcttgatcccaagcggtctcatttccatatcggtaagcggtaccggcttcgatcccggaccaacaaatccggtaacaccacgggtatttctgacaacgtaccaagtgtcatcattcataaccatattgataagcacgtatcccggaaacatcttctttgatacggatttctttgcgccgttcttcagctcaacgacctcctgcatcggtacgcggacctctaagatctggtcttccagatgccggttctcaattgtcttgtcaatgttcgcttttaccttattctcatatcctgagtaggtatgaactacataccagtgtgcctctgccataaatcacctatgcctccattaaaaacttaaaccaacaaggaaatcaacgccatactgaatcacaaaatccagaagcgcgatcacaagacccattactacggaaacagcaacaacggctgctgtctgtcttgcaagtgatttgttgtccggccaaatgatctttttgaattcagccgacaggccgctaaaaaagctctctttctgagcagctttgttctcggtttctcccattttctcactcctttgcccaaaagcctatttggtttccttgtgtaatgtatgagtcttgcagaatctacaatacttcttggtttccattctgtccggatgagctttcttgtcctttgtcgtgttgtaattacgattcttacactcagtacatgccaatgttattttcgtgcgcacaacttccacctccattaaaattctttgtgcttttcttatgtcttttgttccctgcgaccgggcttaggttcccctcaggaaaggagtcctaaaaaaaggcataaaaaaaaagacctacttccatcgctagtctaatatatcacaatcaatatggagcgtcaaccacttttttaaactcgtgcaacaaatttattttagcactacatatagtgtgccgcaagtcttttttctgattttacaaatctatcgcgtaatttttatttttactgtaaatattttatatctatttaccgataaaaattattagaagtatatctattgtacattcaaaaatacagtttcattatatataagtaggaagcaatataaacggatttatatccctgcatatgcgaaggcatatgatttcatggaagaaaggagggattccaatggcagtcatcgacagtgcctatcagtattacctgagcacttatgccggttccggcacgtctcgctacgacacgcacaaaaaaagccagctgcgcgccgtatacaataatattgtcaaagttaataaagattcccccctttacaaaatcaattttaccagggataccggccgttttgccatcgacatcaaggagcaggcccgctcgatcgagaattttatcgcggcgctttcaaacaatgctccggacgacaatgcggaacacgctttttcccggaaaattgcgcagtcttctgatgaggacgctgtgagtgtgcagtacatcggctcgaacatggacgcggacaactccaagcagttcgatgtgacggtagaacgtctcgccacaccgcaggtcaaccgcggcgtctatcttgccccgggcgcaagcgactttgtgccgggcaattacagcttcgacttgaataccaatctgagttcttatgaattccagtacacaatcagcggcagggacaccaacgagaccgtgcagcgcaagatcatgcggctgatcaacaatgccaatatcggcttaaacgccacactggtctccaacgaccgcggacagaatgcgctttccatcacgtcgcagcagaccggtctcagcgataacgagcagtacctgtttgagattatgccggcgccggacagcggttccatacgtgccatgcgcacgcttggcatcaatgatatcacggaaatgccggtcaattcgctctttttgttaaacggtaccgaacattcgtcactgtccaacacatttaccgtcaacaacgcttttgaactgacgctgaaagcccccagtgctggcggggaaaccgcaacgatcggcttcaaagcggatacggatgcgatcgcagacaatgtgcagtcgctggtcaacgtctacaacaacatgatacagctcggtcacaattaccacggcagtcaggagtccggcaagcttctccacgatatggagagcgttgcaaagtcctatttcaacgagttggaatccatcgggctaaatctgcagcaggacggatcgatccatattgacaagagcctgttgaccgacgccgtttccgcaccagacgcgcgcgaaagttttcataccctgaataatttcaaaaacggtcttcaacgcaaagccacccaggcttccatcgacccgatcagctatgtcagcaaagtcctgattgcctacaagaatccggggcacaattttgcggcggcttatcactcttcggtgtattccggtctgatgcttgatacctattgttaaaaggaattgccgcaatacgcatagactgctttggggtgataattattattacagaaataccagagaacaaaaaagttccagaataaacagacggcgggaaattctttgaagaaaaattcacgtatttcttccttgccgtggctggcatcccattccgtgtcttggccacgtttggacactcacggagtgtgtccgacaagccacagacaatgagcggactttctggtgtccctaatggcacctcttcacagacaatataaaaccgcgcgaaccgaaactcgttgccatctgctattaaaaatatggcagatggcaactcaaacatcggcttcgcgcggttatgttttgttcgacataaagatggcatttatgccatctgttgtctggtgccgcaagggacacacacaaaagtcctaaaattgtctgctggcttgcgcacacagtccgtggagtgctccaaacttggaaagacacggatcatcacggatgccagctgcggcatggttagaaataccggattttgcgatcagaatttgccgccgcatggttatctggaacttttaagtatctgtttcttataatattacttatcagcccaaagcacgatatgcttattgcggcagttccttttaattagcgcggtccggcagtgcgccgccacctatttattttgcgtcttcacctgcaaccgtatccagaatggtgtggattctttctatataagagtgcttctcccgcaccttgtggtacccgttccatgcaatccgcttacgctcctcctcgtgttccagatagtaccccactttctcacacaggtcttccagaccatcaaagcagacgaggtcttccccctccttgaaatagtacggaatctctgcctggtagttcgtcagaagaaagcccccgcagccaagtacatcccagatgcgcagcggaatgccgctcttgatgttcggtatcgtaaaattcagattgatcttcgacatgcggaagaccttcggcatctcactccagtagtccactgacccgcaatactgaatccgcagcagatcactgacatcgctgttgctgtaaacattgaccctgtaatgctttgacagctcaatcagcgctcttctccgctcgatctctgcaatcttgaatccaagcacggtcgtctggaaaatcagccccagatccgaaaaagatccctcggatttttccagctgaaaatattcctgcagctgttcgagaatgttcgtggtcagcatcggctccacgatatttgctccgctgatgttaagctgcgcctccataacagcgtcaaaatatccccttaaatactccggcagcctgtttttgatcttgtcataggaattgcgttcataaaggcttcccacaaacgccacatctccgcggtatttccgcatctccgaatcctgtgtggcattccgtctttccggtttttccggcgccccgagcagcgcatccatccgctccgtatctaccgccagcgggagataccagatatgttttacgcccatcccgcggaactccaggtaattcgtcttatcaaacgtaaaaatgtaattgcaggcgtggaacaccgattcatggtacatactgatcagcggattgtcgcatgtccaggaaacatatttcacgcctgtgcgctcacatacattcgagatcaatgggaaatagttcaccgtaaataccatatcataatgcgtcccccggatcttctcctcgatcacccgctcaaattcaggacttacgtcatagcttccgagttcctgttcgatattgtccaccgtatgtccaagcagcaaaaaagtctgctcaatgtctctgtaattatatgctttccatcggtacatcaatatgtgcatagctgtccattcctctatcctatatattgccttctttgcagtactgcgcgcagagacttaccgcctttgttcgccttaccgcgcgcagaagcttacatttaccgctcccatcttcgcccatgtgcattcgtcaggtcagaaagcactccttcagatactccgcacggcttttccacgtatgaccgtctctcgccgcagcatatccacaatctgcaatctcctgtgcccgctccagatgtccaaacagatcaaacaccctctccggcagtgttccaagctcctgccgccggaacatcacaagttccctgccatcggtaaattcgcggcgcagataggtagaatcgtcggttaccaccaccgctttcgccagcattccattaaaaatccgatcgtgcgctcctgccttaaaccaggtcatcgtgttcaacacaattttggcatcgttcatagacggaaggatctccggcgcaagaacttttccacggtaatcaagatacgggctgccgctccactcgcactgatcccatcccgtaccgtacgccgtgacccggattccgttttccaccagaatacgcaccgcctgctccctgaaaaacgaagtggcgtaggagtcgataaaacgcatctgcacaatgatctcctgcacgcgcttgtccgggatatcgcttcgccggtctttaagatactcttcaatgacttcctccgtcgtccggtccggatggtgcaccaattccgccagcacatcccccgccatcagctgtccgtccacttccgggatggaagacagatccggtatcatttttgccaccgtataaatcggaagcgctccggcatacagaacgtcaatccctctctccgcaagcggcttgtgccggcttcccagctccactcccgcatgcggaagaaaatccacctgatggatatttttaaaatatctgcggatatattttacgtgattccggtctgtgcagagcacaaccgacgtctccggcgccaggcgcagcggcttctcatagtgaaacggatgatccatcagaatgttgagatacgggatgccgtaatattcccagacatttctggtcccacccttttgtatacacgcatcgttctcccgtacgctctgtgccggcgcaggcacctccatatccagattgtatcccagattattaaatgtcacacacgaaaattcacgttccggtgctgtactctccgcaagcagggacagcagggcatccttgctctgcggcagccgcgcgtcatatacaaaggacgcatagtccatcgtctcaaaggcttcccgcaattttccggtaaataaatcaagtgtgtcgtatacaccgatgaaatagataatggtatgcttcaagatactctccttctatgagccgatcagaacctttttcccgtcaaatgcaaatccatattttctgatccgctccctcgcaattccgtctgccacaagctctgtctcatattgtttctcttctatctgctgcaacgcccttgcaacgcacgctttcatattctcgtctctctcccggtcaaaaaccttaaattccataatgtaagaattgccgttttcttcccgcgcgcggagaataatgtcatatcttcccagaccactctccctgtttgaccgtattgaaaactgatctgataaatctgccagcaatccaagcacaaagccatagtaaaagcgctctgtctcatcaatattaccacgccctgtgcctgtgtcaaagtaactgaaggtggatagcgtgaccatattcatatagtagttcatctcttctatattatcatgcagcaacgctcttctgaaatctccatagccagtatccatatcgttaaaccattcccgtataatgcgtcgaaacataatctccacttctttgttcgtcagcatcagcacatattcctgatcgttcttttggtttacgcgtagataccccgtcgcatatagaaggctgaaaatagccgattcccgatactccaattgtgcaaagtccagttgctcgtccatctccacatgtaacatctctccttcaagaagctgttccatcgccatcttcatattctttgaagactttcggattaacgagctcaccagtttattattacttgtattcgcccaataagtatcaaagatcccctctgcatcgataaactttgtgatcgaccacggattatacatatccctgcgctgtccaaatgtaaatccgtcataccattcttttactttttccctgtaatcgagcagacctactctggcaagtcccacctttacctcttcttccgtaaagccaaatgccgtctcatatttcgtactcgtttgtgtgaccacatctatattattgaggtcggagaagatagattccttgcatattctggtaatgcccgtcagcaatgctctccccagcgatggattcgttttaaaggaattattaaaaaaagcccccacaaaagaaaccatctcatcccaaaagctattaaagtaagcttcctgaagcggagtatcatattcatccagtaaaataatgggcttatgcccataatacacatagagcaaatccgtcagaagccgtacggactgcgcagccgtggacgcatccatgtcccatgatattctgccaaaatcctgtcgttccctttccgtgaaccgcgacatgtcaagtatccgctcaaagcggcgatatacctctataataccataatttatctgccgaagcaccgcctcaaacgttgtccccttaacacctgcaaatgacagaaatataacggggaaacgcccttgcagcttgtgatagcttttctcttcccaaaccttcaacccctcaaataaatccgcacgattttcatagaacacggaaaaaaagcagttcagcatgctcagattcaacgtcttgccaaaacgtctggggcgtgtaatcagcgtagtcgtctcgccagattcccaccactgccgaataaaatccgtcttgtctacataaaacatctgatcacgtcttaacgcctcaaaatcctgaatgccaaccgcaacgctcttcttgcctgtaatccgaacggtgtacgctctcatgcgccgcaaacactcctcttctccaggacgttctacatccactggaatccaccagcggctgccttctttgtatgcaccttcaatctgcccgtttgcgcaccagtaatttaccatacgcttcgtgacagaccattctgtagctttctgtctggatgtcatatattgcattgcatgccctcccctaactgccccaattataagcccgtgggtgggaaattgcaacgtcatttcccagttacttcccagttatttccttatatgttcttatccttatatcacatgcaaggatttaatgtaggcttccaccccggatctgttatgtaaattataaacccgatctatctgtccaaaatattcacgaataaaatggcagggttcccgttgtccctgccatcttcttttaagcattttcgatatcgctatcatcctttccgcagcaccagagtcaataactctttcacaacctccgatgtacctgctcccagaatagcctgaagtgctgcttttcctacgctctgcatataagcctttaaaccggataaaatccccactgccagtaatgccagtcccattacacttaacgcctcgatccctgtcaaacatagtagaaatccaactgtagcctcaaatacaactctatttgcatcccctcatatatccaggcacgagcacgacactacccttacctaaccagatcgtagctttccgctatcatccgctttacatctccatccggcacactgccgtcaaggatgaccgtattccagtgctttttgttctgatgataacccggaatgactgcttcgtacgctttccgccagaaatcaatccactccggatctgccttgacattaatccgcatctgtccctgatattcataagtccagagaaatgcccgcttatttttccgggaacgcaccagcacccagtttggatcgtgaaacggtgtatccacatagacatccggaaatgacattccgtattccaatgcttcttctctcgttgtcatagctttttcttctacctccgccccagctcgcgtatccgctcctctgccggcgcatagccgccgcacttccggtaataggcaagcgcctcttcctttttcccgaggcactcgtagatgacgccgatgttatagtctgcccgataggaattcactccctgtgcccggcactctgcatgcccggccgctttctcaaattcgcgcaccgcctctgtgaaccgtgcgtttttcatgtaaatcaatcccatcaggaactgaaaatccgcactttttccaaattcgtcatagatattctcaaaaaacagtgccgtctgctcctgcccgctgttgattaacgcatatccgtacgtctccaccatgtcaatcacgtattccagtgcaggatttaggtcaaacgaaagcccctgcgcgaaccagccgcacgccgcgccgtattctcccatcatgtaatagctcttgccaagctgatacagaagatacggaatctgcccgctccaacgagcattcgcatctgttccggctgtctctgcctttgcgacgccgtcttttgccccggcatttccatcccagcccagctgctttaattcctgctccagcaggcggatgttgcgctccgccttttcctttttctgctgctctggcagatcgtatccggtgtgcaagatcacaaccggcgtctcatacgtccgataaccgctctctgcgccacgcagtggcgtcacctgctcatggatcctgccctcgtagtgaaaatattcttttgcgaatatgcggttgatccactcccggttctcctgctcctccccgtttctgtgaaacacattccgcctgcggatccggccgaccgcccccggatgcgcgacaatctgtttttccagcgcggacagatccagctgctctacaaactcgtcgctgtccaaaaccagtacataggaatgtgaagccttttctatcgcaaaattctttgccgccgaaaaatcgtcgcaccacgggaaatcatacagcctgtccgtgtaacgcgccgcaatctgtttcgtgcggtccgtcgatccggtatccaccacaatcgtctccagaccgtacggagcaagcgcctttaagcatcggtcgatattctgttcttcgttttttgtaatgatacagatggataggttcatgtgggattcctttcattttccggatcgtattccaccatacacaatcatacacgttactttttattttcatgtagcatgtccacaatctgctgaagcatcatattgtgaatggattctaccatcccatattgtctgaccggtacatgcacattaaaatttcccatcgccctcgctttattatccgcatcaaacccagtaaaggtaatcacatatgccccatgttcttttgccgttttaattgctcttattatgttttcggaattcccggagctgctgatgcacaccaacagatccccctcctcgatcagcgattccagttgcttggaaaatacatgttcatagccatagtcatttccaaggcaggtaagaaccgcattatcgtacaagctatatgttctcatgtctccgtttttcataaagtccgccgtcatatggcttgcaatcgcagcgcttcctccattgccgataaaaaagacccgacctttgcccgctctgaccttctcaaactgtctcgtaagcagctccatgctttcggtgtagcttgtattatccagaccgttctctccggaaaatcttatattgtcaagcaattctacgatttgttttaaataactgtcacgtatcatctgtaacctccgtataacctttcaagcgccacatttctccgcaaattgtccatcggtctattattcacgattacttcgtatcaggaaatacttgagtcaattcgggttttatagttttatagttgtatcttgcccgccagcagcaatctatcaatctttccatttgcgtttagaggcatctcttgcagtaaaataattttcccaggtaacatatatcttggtatatgttcctttaagtatgtatatatctgcttctctgtttgttccaaatctccaacgcaaaacaatacaatcttatcagcctctttttgatatattgcacagcactgcttgattccatctaatccataagtagcggtttcgatttctcccagttcaattctatagcccaaatgttttatctgaaaatcagttcttccaacatattcaagttccccaaattcattatactttacaatatcacctgttctataaattttatcttcatataatgaattaagtggattttgtgtaaatacctgaagggttttttccttgttatcataatatccgtttgccaagcaagtgccccgtatacacaattcgccttcttctccctgctgaacccttgtattattttcattcagtacaattatgtccgtattttcgcaaggctttccgattggtagtggttcgttatctgcaaacggcctatttacaacaaaataggtacatgcatatgctgcctccgttggtccatacaaattaacaaactcggtcttggtgtaatactttctccaaatattcagatgcctattgggcattatttccccgcaaaacatcactaaccgcaagtcatcaatcttctttttttcaaaataatttcgatttgttaatgtcatcagcgctgacggcacccagattaatgtattaattttatactgattgatataatcaaccaacttattcggaaccagaaacagcatttccggaataatatataatgtaactcccatacatagcggtgtatatatatccggcatcgacgcatcaaaatagaaaggtgcctggtttcccaaaactgtattcttatcaaaaggcaaatacgcgcattgccattctatgtaatcaacgatcgccctatggctcacgacaacacctttcggtgttccggttgaccctgacgtaaataaaacatatgcaggatctgtatccaccactcttcctctgtaattttcaagcacctgctgttcctcaatagccggatcatcctgtaaataaatgacttctccctcatatccagcctcgcgcaagcggctttcatactcgttttctacaatagccacttctgcctgtagcaagcgaacaattttctccaaccgcggaaccggcatttttacatcaagcggaacataataatttccgctgtagagcactcccataaatgctatatactctgctattcctttattgccgaatataatgatgggtctgttatttatgttattatttttccgcctaatacttactgctactctttgtgagcgatcatacagctcctcaaaactcaaacttttttctccgtctgagattgccactttttttccactatcaatctttctttgatccaagtactgtgttacattagttatcatattgcgtaccctcaatttgcttttttacgaactttgtaatgcttaaaatatcttgaaaatcttctaactgtaaactttccagtggaatttgtatttgatacttatcctctaattcagatatcagcaataatatctccatggaatctaaaatttcttcctccaacagcttcgtatctgtttctatttccatatatggatttatttcctgtaatatatgcaatatttcctgttccatcgttacattacctcctcaatttttcggcacaatatttccgcaactttctttctccctgcatcattagctgtttcatcaggcgtgtctggctgagcgaattcattctgttttaaactatagctcatttccaaaagctccagatcattttctcttactatactatcaattttatttacattcttagcataacgtttattaaaatccgctccgaaaattctttccccaagttcgtaattcaccggcggtacaaatggaattacttttatattattttcccttgccagttgaattatttttttcaaatactgtatcccctctgtttccacatccaattcataaaggtaattaaccctaaagtatactttggatttcgcatcggaaggaacatctctttttccaaatttattagtagtaaaaaattctgcctgaagattctttttgcgttcatgcacaatttcgagatattcttcatactctttgctgtctacatgagccttttcgtataccattcttaacaattcttcatgctgtgatcttggcaataaatgctgtttacctgttagcgtatccagatttatcataatcactaatatcttaggaatcatccccatggcaatctgcgtatgcagcaaattataatgcgatcgtaatcccattccatgcatagccaaaacttttgcccggcgctctcccagttcgtcttttaacatttctgccaggttccgcatatccgtatcttccaaagagattttcgaaaattcacaatctcccataatcaacacatctcttgtataaggacgaataaattcttctacatatttttcatataaatttgatctaactgtaaaaaaatcttcttcctttttataaccatcttcttcaagaaattcttctatttctttactattttctgcggatattaatatttttacctttcctgtctggattttctctctcattgtatccggagaaacaatcggaaattcattgatgtatcctccccatttctccttgttactatctacaaaaaaaatttttgtatagtttgttcgtttaaaaaacaacgaaaattcagttcctcgaattcctgctccccaaatagcaatctcattactttccaacattgttttatgtgctgtcatccattcacaaaaagctacatattcttccttgctgctcgaagttaccggccacgcaaaattaattttctgctccatcttccatctcctcatttctgtcaatataagcaaggattttatctcttccgctctgacaaaccgcatcgttaatcgttaccatcgaaacaaaatctccctcctccagcaaatcacccatatcccaaaattggcatttatagtcatctgcaagcttcttaagcacccttctgtttttttcataaatttccacaaattcttcatgatataatttctttgccagttgatagttgataggtgtattgataacatatcctgcaatgtcatattttctaagcacttgcaatattcttttgaaatataacatttcctctgtctccaaagataatggtcgaagaatctgaatcttcatatactctttttgaatcgtctcattgtcaacgtttttaccgtcaaatgttctttgtggagaatactgcatttcaattttataatttcttgctctttcctctgcctgctgtatgtactgttgaaaatactcatcccggatttgtcctgtttcagcgatcatcttcaacaaatccggatgttgtgttctcgacaacatatgatgaaattccgttaatgtttcaaaattgacgaaaatccataccttttggggcacatatccaagcataatctgcaaccgtatcatatgataaaagccctgcattcccatgcaattcattgccaaaactttcatattttcttttttatatgttctccacaggcagtcctttatactttccggattttcttcatcaatgattgtttcatttaaaaaagtttcacctataaccaatcggtcataaccatattgccgaaaaaattcttctgtatagcttttttcaatattggattttataactgcaaatgaatcctcttttaatccccaactatataattgcttacaaatttcttcgggatattctaccggtataagaataaaagtattttgtaattgattccttacctcgttcggatttaagatggaatgcccattaatatgatttccccattttcgttcatcattgtcgatatacaggaaatctattaacccctttttttcaagtatcatacccagcaaagtgccgcgaacactcgcgccccatactagcagctttttattttctaaaaacgatttattttctattacaaattgatcaaatgccttcaatatctctttttgtgcagtttttaatggccactccattcgctttgacatccttttttcatccgttccacaattttttctgcgattagctttcttccatgttccagaattccctcattcgtggatctaagacagataaagtccccctgaggcagcaaataacttaaatctaatatacttcctttgccatttatgatatgcctctgtaacaccgttataatttccccgtaacgagtccgaaattcatcaccaaaatactcttctccccgctcataatttatcggcataatcacaaatgttatctttatacctacatttctacagaaatctaagatatgatgcagatattccatactctctgtattttccgatatatgatacaaaaaattgagcttcatatggactcgtctctgattctcaacttccttttccgataaatgtttataacgattcggagatgacaaatctaagatacttgtccctttttctctttcttcaataacttgaagaaagtcctgcatctctttatcatccgtttttttactttttttatacaactctttcattactctgccatgctggtttttgggatacaaaaaatatcgatttcccattatgtcaacattcagcagcacataaacctcttgtaaatatttcattctgtttttgcatagtctcagaatgttataatagcttctcatatataagccatttaatgcaagtacttttgtatccccggtttttctcaatatttcgcctatcgataccttatatttctcttgcacagagactgtagacactgtgcaatctcctaaaatcaagacatgcgcatcatcatttttttcaaatgaatccagcaatttcctttctgagcagtttgtcagattaacccagtctatccccatctcaaatcccatttcttcaagctgggtcgcacattcttcatagttttccattgcaagataaacaaaatagttatctccattttgtaacagcatagggttatttatcgttgtaccgactagtcggacaccccatttttgcgaatcgttgtcacaaaaaataaaattatttattcccaactgttgcaacgtatacgcaaattgcattcccataattcccgcgccaaatattacaatttgcttatcctgtctcagtatgcttgttgcatctacaatctcgcagaaattattaaagctttcttctgctatacattctattacaatgtcttcttttcccatgacataacctgctctttctatgatactgttgcttataggttatctctaatttaacatttcctgctttgacaaaacataaagaatcgagtttctatcaaaaccgcactttttatacagatcggctccaaaccattttccccctaattcattcacttgaaatccaaccgcttctaatcttttcataaaatcatctcgtgcgtataacctgcaatgatctccctgcccgaatctgtgccagttttcttcttctgaacatccccattgttcatctgtattttctaagccaacaataagcggcacaagaacgatgcataatccttctgcctttaaaatacgatataattctttcattgcagatatgtcatctttaacatgctcaagtacatgggcacagataaccagatcataatagttactatctaccatgtccatcttttgtatatctgctttaaaagtcacattatccatatataaatctgttgactcatagatcacatcctctcttgcccgcaagtatctttctatgacagaatccggcgcaatctgcaatacctttattttttgattgttttcgcttttaatatacgacaaaaattcaataatcagtcttgccctatctgtcgaaccgcatacaggacagaaatagcgctctcggttttccagttgaaactcgcgattccaataagggaagccatatttcattctattttccctgtaataatcagatattggatcaaatattactctatttttacataccgagcaaacataaatctgtcctcttaatttattttctattttatctgccaatttttgatattgatgattgtactcacataactcctgttcatcacatatatctaatccaatttgctttgaaaaagtttttattccctctataatttcttctgcctgctgttcctctatatccttctttaaattttcacataattgtattattagttgtactccctcatattttcggttatgagaatacagcaacttttgctcactaaaacaaatttgatatatttgtttccactccgcctcacattcgtagaaatttctatggtctaatacatactcttgtaatatttccaagcacccatagcgttccgcttctgctctcattatttcaaactggggaattaccttattcaagcgcttataatcctcccaaaactcttccaatatataaatttccgctaaaatcttattctttccattttgatttacgctgtcctttgttagaatctgtcttacaagcggcatttcaacaaaaccaacttcattgtcctttgcatatcttaaggcaaattcataatcttccaatgctcgcaaattttcattaaagccgttcattttgtttattatgtcgcttcttacaagcattgtctgtgtactaatcaatgcatacgttagcataaaatcaaaaatcttaccggaagtgtatttttctggcaattttttttctggaattagcgaaagcagccttccctttgcatcaaactgaaccatagcacaatatacaagtccaacgttgtcagttccagccattttatcaatctgcatttgtaatttttctttttcccatatatcgtcgctgtcttgaaatgcaatataggttccattggcttcttttataccaacatttcttgcgcctgcagctccatgatttttttccagatatatgtaccggatccgatcgtcttttattttttttatctctgcctccgtattatctgttgacgcatcatctataataattacttctatatttgaataggtctgatctaaaacactttttacagcatatgttactttatctcttctattgtaagttggtatgataacacttatcaactcttctctcatgctacgttctctctcccacatttctaatgcattctctgttgaagctcccgaatgtaatccacattatttcctgttgtaatttcttccatatatctttttgcgttatcaaattctcccataataatataggacatcaatatttgattttccctcatccattcataagtttcatttgaaatgctgtcaaatatgtcaggttccagcagcattaaaacatttttcaaatatttgctattgcctgcattcatataacaccatgcaatatcccccattaaaattgtgcgtaccttagaattatatgcctctttccgaagaagttgtaaatctttattagcgcaaacctcgcttatcgtttttattttttggtctgtatcccaatctgctctaataatgtttttaaataactgttctatattctgccagaatagcagatcaaccattattacattttgttccgtatacgcatttaccttatgtaaaaaatgatgctctgtttctcttaaagccagacagctaaatactctattggttcctattgtccgggtagcataactgttattatgaattctataatgatacattctctcattcacaaaagccagtttcttacactcgcctaaataacacaaagcaaatgccacatctcctccgaaattatctccttttttcagtttttcccctatttctttcatatcaggcaaaatactgcaaaaaatttccctgcgaaacatcttaccccaataagttcccatataagaacgcatttctatgaattgtttttctatatcacttttagaataaaccccatccagttctccatattcatgcggagtttcccttcctgtttcctcctcataatttactgcgccacaaatagatatatccacatcaggatcttcaagtggcgcgatcaatttttcaagatactctggttcaatccaatcatcactatcaatttttacaatataccgtccgtctgctttttccgcaatataataatttgtaaacccatcctgatttacatcaaaatagtctggtttaattcgttcatcaagtgctgcatatttacgtattatttctctcgttttatctgtcgaaccattctcaactaaaatccattcaaaatcttgaaatgtctgtgataaaacactcttaatacattgttctatgtaattctcaacattatacgcctgtgtataaaccgtaacacattttgacattctacattctcccaaccctaattttatagccgactcctcttacccttgagtcctattgattctttctaatatttcttctgcatatgcatctatactatcttccggagtcattaccgtattctgtggaatataacaatttttacacgcctccattttaaatcttcctgattcaagcatatccttcataaacgcctttttctgcgccccattccatgcctcatatatcgtcgtttccttcacatttccaagtttaaatggcggtctgatatgactgcacgggtatatcgttccatccggcagcacattaattgtataaaagaccaacggacagcattgctggactttaaacgtatctccgtatttatttttttctacttctccagtcttcatatccgaatccgtccataaaggcaccaccgattccacaaaaacacgatccgcaataggcgaaaacatctcataaaacctgtctctctcatctcccacagcttcatctacaattttaatatgtatctgtgtatctcttttcttctggtaaaagtatttcaaatgataataaaaccgttcaaaatcgattttaactccacactctttataatatgcatccccgtccagaccctgcagggaaatgactaccctgtcaattcctgcttcacacaattcctctatatactgtttatccaaaagtaatccattggtatgtatctccgttctcccggtaagaccggcatttttaatataactgaccatttgtggcagtttcctgttacacaaaggctctccattatgtgacaaggcaattcttttaatctggcttggaaattcttttaactgctcaacaactatttggaacgtttcccaatccatcagacgatttttccgataatcttccgccccaatgcttgtatcataacgaaagcaatatttgcaacgaagattacaggaatcacttatatcgatcaataccgtatagggcgtatcaagcggtaatacttttcccagtacatttctatcctgactatatgattttataatattactataactcatttccagtctatccttcctgcagaacgtatttgttcatccattccttctcaaaattctgaatatatggtaacgccaggaattcctcctgctttagccgcagttctctgaccaattctatgaatatgccctggcagtcctttagatcataggtttttattttgtcgcacatactgatcatataagaccactcgctgtattgcaccagccccgtcaattccggcagtttagcactgatatactctgtcctctcacaaaacgccgccagatattcccgcatttgttctgccttccacaaacctgcattttgtgtaaaagaactgttattgctctcatgccgggtgaaacagtatttgggcagtccatacgctgccaccttattcgcatttgccatatatttgtaacagatccagatatcctcgtatttgcagtcttccttgaacggtatctgttcaaacaattctctccggatcagtttggttggcagccctgcattattgcgcttgcgctttaaaagttctgtcacagcatccgccgcgctccagatacagtattcatcccacatgctatgtggcagaatctttccatttacatccttttttgcaccgcatattgctatatctgcatgattttcctgtacaagccggtctaaaaattccagcatgtccggtgcagcaacatcatcatcatccacaaatgcaatgtattctcctgttgcattcgcaattccgatatttctcccatgcccaatgctgcttttttcaatgtgaagcaccttaatccttgaatctcttaacgcatattcatctgcaatcgttccgctttgatcgcttgacccgttgtcgacaatcacaaattcaaactgtctgtatgtctgcgccaaaattgcctcgatggatcgcgctatatacttttccctgttatacgtcaacatgatgactgatatcatattttccacctaaaatcctatcaacattacactcaaaccgtctccgaccgggattctacgcagttggggatgctcgcttacatactcatcgattgcctgcgcaacaccgctataacttttcgtataataatcatgggaaattagaagtccgcctttttccatgcgtttcccaaaccactccaatcccgctttcgtcggtttatacatatcaacatccagccttacaaacgcaaatgtttcctctattccttccgcagtttccggaaaatagcctttctttataatacactgatttggatatttcattttttctaatacacgctctacggatgtatcctgataatcccctgctttcgcctctgaaaatcccgctttcttttccgtctccacgtcccgttcatcaaatccgctgaatgtatcaaacaaataaagctttctatccgcaaatgcctgattgatgattttggctgtatctccttgaaatacccccacctctgcacaggctcctgatgtatcccttaattctctcgcatattgaaaaaaggaaagttctctattattattcacatcggatgaatacttctttatcttttcctgagcaacaccgtagttttccagctgccgacatatggaatcatacccaggcacagaagctattacgatataatcgtaagccatattcacaatctgctctgccgaaacaacaggtacaccgccgatatccgtttcctgtattgcctcattattatctgcataagcaaccacatcgcaaaactccctataaaatgcgtaagcgcgttttcccgtcggacccgcaccaaaaataataattttcttcatcgtgtgtcctattctccccgatttttttctgtaaaaataatgcgcgatccctcagtctcaaaaccaaactgggtctccttgtattcactcattgctgatcttactctttcctgttcttgcggcggaacaaaaagcaacataaaaccgcctccacctgctccgagaatttttcctcccacagcgcctgcgttcttcgcctttgtatacatctcattgataagtggatttgagataccactggacatctgctttttcaaattccatgcatcatccagcatcttgcctatttgagcgacatccccttctgccaatgcctgttccgccgacagaaccatctctaccattgcatcaagcactttctccttgtcatagatatgagctttctgctccgccagaatattggatgatactctggtgagtcctgtaaagtacaacataaaattgttctttaactgatccagcgtgtcctgtctgcatacgaccatctcattcgtaacgcttccgtctctgtgaaacttatatttacgaaatcctccgtaggcaaccgcatactgatcctgcacgccgatcggattgctcagacgttcaatctctatctcacatgcttcccgcgcaagcacttccggcgaaacatgctctcccttataagcatgcagcgcatttaacactcctaccgcaagcgcactggaagaagccagtccgatacctgccgagcttaacggaatatccgccgaatacacaatatcgatccccttctctatcccgagcatttttaatgcttcccggataatattgtgtttgatctgatccaccgaatcaacaaattcattgacggtatagcacactctgatcttatcatcaaatctcttgcacaccataatgtatacatacatgtccaacgcagtgcttattaccgttccatatccgtaacggctgtttttatagtaatcagcaaaatccgttcccccaccaaaaaaagacattctaaggggcgttttcgatattatcatctgttattctccttgcatcactttaatatatcatccacggcgtgcctcaatgtatagctgttatccacaagtattccacggcatcctgccgcatgcgccgcctgcatatcccgttcatcatctccgatcattatacactcccggaggttcagtgaaaaatctctctgcgcctgaaataacatacctggtttgggtttgcggcactcgcatccctcttcccagttatgtggacaataataaatcgcatctatggctgctccaatctttgccagatccgcctgcatcttgtgatgaatctcagccaatgtctcctctgtcagattccctcttgcaattccaggctgatttgtaatcaaaatcagacgacaccccgcctctttcagcatacgaagcgcctcttttgcgccatctatccacacaaacgcttccgcactctcaatatagtgcgctctgggtggcttgacattcaaggttccatccctgtccagaaaaatggtctttatccccgagaaaaactgctttgtcaattcgattcgttcccatgatccaatggaataatatctgtgttctgtaagagtcgcaaatagttttccgctgttgacaagtttgggatacatctctgcctcaaaattgcagtttgcatcgggtatctgttcgattacctgttttgaaataatcgcatatcctatatcaaccgcgttcaggttctcctgaacccgttttttatcatagcatcgtacacagtcatccccgtccagccttaaattgtttttcgtataatgctccttatttacatatgccgtaatctgtacggatgcattatttgtatcataatcctgctgaagcttttcaaaatcaatcgggcaataattatcgcagtacatcaacagaaaatcttcctgtaaaaagctttctgccgcttttattcttgcaccagtttcatactctactggcgttatacaatacttgattcggacaccataccgactcccatctccaaaatactccgtcactttctccggcaaatatcccaacaaaatgacaacatcttctattccaaaacctttaatctgtctgagcaggtagcccagaaacggttccccgttaaacggatacatcggtttcggatcatgttccgtaaatggtgccagacgttttccgtaacctcctgcaagtatcactgcctgctgaacattttttctcttccgcatctttccctttccacgcaaaaaagcatcctgctaccggatgctttttgatcacattatatatcttccatgattttctgacagccatccatgcgcttctcattcattatatattatatcggctatccttacaaaaactttattttcaatgcctctgccagctgctcattctccctgcggcttcttaccgcaatccggacatactgtcttccgttcgcaatctttcccgtgagatccttaatcagaatctgctcttccagaagctctgccgccagttcctcactcttcctgccattgaccagctcgcacataaaataatttgccgaggacggatataccttcaatccctcgatctggcacagcttccggtaaaaccgttctctctctttccgcagttccacaagtgcctcttcataatctttcttatacttatcaagaatctgcataaaaaattctgccatggaattgatattccagatggacaccgccttctttatccggtcgagccgctccttgtcctgcgacgccagaatcccgaggcgcagtcccggcaccccataggactttgaaatgctttttacgatgtagagtccgggataacggttcagcatctcatccgtaagcagcgacgcctccttatcctccgcgaaatcgagaaaactttcgtccagaatcagcgcaatgcggcgctcctttgtccactccagcagctgctgcacctcttttttcccgaagcagtgaccggacggattgtccggattgatcagaacaagtgtctgtaccggatgctctgcaaaatagccgatcagatcctctgccgtgtaggcaaaatcattctgtcttgcatcataaacgacgcactgctcactgcaccggttcggatactcctcgaaggtcggacggatcacgcccacttttcccggaagctcctccagcagcgccttaatcagctccgccgccccgtttccaagcacgatatgttcttctgaaataccgaatgtttttgccgccagaagacagttgacccgcatccccgacggatactgccgcacaaggatgtcaaagttcgactttaattcttccatcatgcgcgccggcggaaaatacggatttacgagatagcagaagtcctttaaatgagggaatctccagtagccgccataccgcgaagtcaattttttataccgttccccggcatctgccgcaaacagtacctccgcaatatcaagatcctgtatgtcgtcaatctcataccaccgctgtccttccaggcgctttgccctcatggtgtttttatccagcatcagaatcagcttgattaccgcttcataatactcgttattccccatgaccctggcgtacgcttccagaaacggcacatacacattccgggaaaaatctgcactcagcttgtagatattgaccgtcttgtaatagcgctccttctgcgaatactccaacagctttcccggaataaaatcgacaatccggtcgtcctcatccacaaccagacatgtcccgtccatccagttttcaaacttgtccacaagcgccagcgtctcgcgcgaatcctcaagcaacaggtcaatcagcgcttcctcaaaaatcagatccgattccagcaaaagggtatcctctttcacaagccagtcttttgccatggagagcgagtatatgttattggttctgtcatacacctcattgatgatgtattctaccggcgtatcaattcccagtctgtcgacaaactgcatcagattttcacactgatagcccacgaccattacaatcctcgacagattcttcttatccagaatgtatagtgctctctctatcaggcgcacgccgcccacttccaccatgcattttgtattgttctgagtaagctttcccagacgttttcccattcctgccgctaaaataattgcctgcataccgtcacccttcacgcattattctttatacaaatagcaatcaaacacaaaccggttattccagtacagttcgttatcaggttgtacgatctcacatctgcccccgtgctcctctgcaaattgcaggaacatctctctggtgtaaaatgttttgtccagccccgcatatacttcatcataattctcaacacacttccggcggtatgccatgtgttcgtcttttttctcctgatcgtgcacttcggtgacaacaaccatcttccccgccttcgcccacatgcgttccagcaccttctgcccgtaatcagcatcattaaaatactgaaacacactgtctgccagaacgacatcgtacctcagctctgtcggcaccctgagcgcctcctcacatcccacgtccgcctccggcaccacgctttgggctatgcggatgaggtttttggagtaatccagaccgccgagcaccgccacatgcttcaacgcggaaaatagatacagattcacaccgcttccacagccaatctcatacagactgccgatcgttcccgcacaccccgtctcgatccgctgcgccatgcactcccactgcaggaaaaacgcctcataatatccctgcacatcctgtgtatcaaatccgtccgcccgttttaattccttaaacatttcaaatacggttgcgcgattctcaatcttcgcggtccgcttcttccatatcttatcccagttgttcattgctccatgttccccggcaaacgcccgggacgcctctgtcatcccagatgcttatctgcttaaaaatgctcataaagagataggaagggcattcgtatcaacaaactgcccctcttatctctttatcgtgtctgactatttcaaaatctcaagcactgattttgcatcatcattatactgtgccagaatactctgggatgcatgcaccagaatccggttggtcgaatataataccatctccatattcatgttggtgtctctgatccctgactccgcactctgcgtattttgtgatgtgttgtccgtattgcgcacggcatgttccagacgctcctgctggctgccgaactcgtctctccagagcgccgcctgttcaatcgcgtcctgaaccatcgtgatggattccgacgccttcgcatgcgaagatacattcactttgtctgtgccaaggctctccttgctcgcatttacaaaatggatatctatcgcctgtccgttcagtgccccggactgtatgcggtaatatcccggtgccgcctgcggcgttccctccgccaacatatactgctgattgaagtgcgtcgtataggcgatgcggtccacttccttgttcagctgatccaactcatcctgaatagccctgcgatccgagtctgtgttgatgtcattggctgcctgcgtcgtcagctccaccatacgatcgagaacatcctgcgtctcttggagcgctgcatccgccgtctgcagcatactgatgccgtcctgtgaattccgggaggctttgttcagccctttcacatgatgccgcatcgtctctgatatctgcaagcctgccgcatcatcatttgctgtgttcagcttgtaccctgtcgcaagctttttggaagatttttccatcttcttcacgttatagcgcagctgcctgctctcacagattgccgccatattatgattaaccaccatgttattctacctcttccctgagatttttgatatacttctgatatttatatcgaatcatccgtgctgtttctttagcataacacttccgctactttcaactttttatttcataagtttcttaacatttgatatataatccattgtactatcaatactgaatgctcttcccatcataacctgtgcctcatcggacactaagtatccaaacaattcccggagcttttcaaatgcttcacaagcatcctgcatatgataacgtgcaattacctccgcagacggacatgccccttccaactgaggatatgaataatacaacaatgtcaatgcatagtataaaataaatttagctggcactgcctccaaaacccattcctgatcaaaccaaagtatttctccctcacaataaaatgcatttctaaaactcatatccagaaaaccgatttttaatattggtccaaatacttcctcgttctcttctattcccagatccagtgtatataatatattatccttccacgaaatttgctcagaagatcgcaatatttctccatacaccaaatctatcaatctgtaaatttcatcggtgttctcttcttttaacacgtttaaaattacgtcttccaaaagcggtttttcaatgtaatcactgaccaccatcccattatcagccctatattctactatttttatacccgcttgtttcaaaatatttacatttttgagcagttgccttatatgtgtctgtgcgcataacatcgtaagcggcttcttttcaacggtgctatccctcgtaaatcttgttgccattcgatattgttccttgcgttcgcttgttaatctcgcaaatgttatttcccctagctgactgctgtcggagcactccaccaaaaatgaatttgcaaaaaactcaaacacatgattttctacaatatccatataaagatttttttcatttgcaattaatgtgttttcaccggccgagctgtaacctctgaaattttcagaatttaccgtgtctttcttacttggcaaaacatcctgagagtaaataacggtaggcaatttataatccggaaatggataataaaagtatgtattaagaaaaccactttctctaagaagtatgtctaacgctgtttttgaaaatgtccttacccctctctcaacatccctatactgatttatcccttcaaacggtattccaacatgatcttctggcattccgcaccaatattttaaaccgtactgattctctattgcgacaagcaatttcccatctggtttcagcaactgcttaatcttaaccaaaaagtccatgtacggatttgttgattccgtataagtcccctggtattccaaaacgcctatcagtgtaatatagtcatattttttatcaaattcaatatcattcaagtttccaacaataatctcaagattttctttttcacggcaccggagaagcgttgctgttgcacgttttcttgagagttccactgccgtaacatccttacattcatcgcacagtacacttgtaattgcgcccataccacagccaatttccaatacactgctatctggtttgaatttgtaccaatttagaatattttttcgtagcggcgacaaatgataatatatcggccaattaaattgctcatagacagcattgctgtagtcttccggtctattttctgcaattatcttaattataaaatcttctacctcgccatccgaatataaatcttcgttcttataccactgcagattaaatttagggcgaggattcatttttgcaattaactcttcatacattcttctttctcccttcatcacagcataacttccaaacacttttcgcaagtatttttcacattttacttataaatgcctttacccgcttctgtatactttctctattttccgcttcattctctacccggtacagctccatctgccttggaatcatcgccgcatagggagactccctatagtctgccacctccgcctttacggtatcccgcagcgtctcatacatggaatacggcacttcaaatccgcgctgcaccgcaaacagcagcgtctcatagaaatacgtatgcagaaaatacagcttgatctcctcataatactcccggaaaaacggcgtctgcttcataaaatgccacacggcaagctgcacatctgcatgcatctgcaacgttgtcatctgacgcatatcccggcgcatggttcccacctcattctggcggtagcagtaaaaagcttccgccatgatttcaaagcggtttccgtagaacaacagcggatacacaaacagcggttcttcataaatgacatgctcggcataacggacgcccgcccgctccacgagcgatctccggtacagcttgttccaacagccgtaggtgatcttctcgctgataaggaaacgcttccgctcctcctttgtctgaatctggatgctctcgtccgcggtcgtccttcccgacgccacttttccaagtctttccgtatagtacacataatcaaactgtacgatatcggcttcgttctccaccgcacgccggtataccttctcaaggaaatccttctccacaaaatcatccgcatcgacaaacgcaagatactcccccgtcgcataaccgagcgccacgtttcgggcgcctccctgacgcagattttcttccagatggataatcatgatgctctcgggatacgcgcgctcaaattcctccagcagcgcccatgtctcgcccgcatcgtccgatgcgtcatccacaaaaatcagctccagtccgtcgattccgatcgactgctgcaccagcgacagaaagcactgtggaagccatttcgccgcattgtggcagggtacaattacacttacttttttcattccgcctcccgccccctctttgcccggaaaacatactggtacacctgaaacaactgtctgtccgcaatatgtggaatctgatacagtgcgttcatcaattcttccgcttcggcatccagctcttccgtatcgtaggtcgccatcatctgtgtgacttccattccgcaccgttcaaataccctcacaatactgtccattgtgaaaaagcgcagatgcgtgcggtctaaaattcctgcgtcctggtactccagctttccgcgcagaagatcgctgattacatggcggtttaaaatattgggaacactgcacagaatactgccgtccgccttcagatagggcagtaatttctgcagaatccgctctggatcatgcaggtgctccaacacatccgccagtatgatatagtcaaacgtatctttttcatacgggatctgcatggtctcaatgtttccctgccggatatccagataatttgcaccgattttcgcaatgtcatcctggatctcaattccgcttaccttcgcgtccggccactcatacgcaatatgcgcaagcgttgcaccgcatccgcatcccacttcctgcacgcgtattctgctctctttcggctcggaaatcatcgcaatcagttcttttctgctgtaggtataataggacatatcgaagccccatttttcccggaacttctcacttgtaactgagaacgtctgcttccagatatccgagttcctgccgtttccatgaccgtaatgcacgataaaactattgtggcagaggcgcatctgccaccccgccagattcagccggatgcacagatctacatcctcgttctgccccggggaaaaccgttcatccagaagtccgacctcatccagcgccttccgtttcagcagcatcgcaaatcctaccagccaggtctttttctccagcgcattttccatggggatattcattgccgtgccgtatgttatgtattcctccacaccggcaagcttcgcctcaattctctgcccgttgatcacgctgtttgacatgcttcccgtggcgccgatccgttcctcctcatataaccccatcctaagccagaaaatagaattgggcagaacaatcgtatcattgttcagaagaaggatatcattttccggctctgccgccttgattccctgattgcacccagccggaaagcccttgttttcctggttgctcacgagtgtcatatctttttgctcccgaagccattccagcgtgccgtctgtagatgcattgtccaccacgaccagctcgtagctcgacggatcgcaggtgtcccggatgctgccgatacactgcatattcatgtctttgagattatacgtcaatatcacgatcgaaaccttatgcacgcaccaccggtcatcctgctgtacacgctctttgtgctgctgtatgatcctgcgatcgtcttcatcgctgcaataatagagcgcattttcatagcagagccacgcctggttgcaatttttgcgctcataataattgcccagcagcagatacagttcgtaatttttgtaattgtactgcagtccctgcgcgatgcaggtataggcgccttcccagtcgcccagcgcagagaaaaccgttgctgccagcacggcgagttcatcatcccattccccgttcatatactgcccgagttctcttccggcttccctccacgcattctgctcaataagttgctttaatcctgcatatcccatcccgctctattctcctgctgttttctgatgatctgcctctcccacaccatccgcaaactattttgtcagccgcttcaccgtttcaatgaccgtatcctgctgctcatcggtaagtcccggataaaccggaaggctgatgatgtgcgagtagacttcctccgccaccggacaatgtacttctctgtaaccgtgctcctggtagtacggatgatagtacaccggaatatagtggacattcactgcgataccgttctcccgaagctgctcaaacacggtctttctgtcgtgattcttcacctgtatgatatagagatgccatccgctgttcgtctccggcaactgatacggcgtcataatattcgcgcagtccgcaaacgcctcatcgtagcgctttgtgatctcccttctgcgcgcaaggaagcggtccagcttccgcatctggctgcagccaagcgcacactggatatccgtcatgcggtaattatagccgagatcgagctgctgatagaaccacggtccctcatttctcgtcatcaggtccggatctctggtaattccgtggctgcggaacagcactaatttccggtacaattcctcactgtccgtcacaatcataccgccctcgcctgtcgtgatcggcttcaccggatgaaagctgaatgtcgtcatatccgacatggagccgatgcgccgtcccttatattccgagccgagcgcatgcgccgcatcctcgatcacgatcagatgatgctcctttgcgatcgcatgaatggcatccatatcgcagggctgtcctgccagatgcaccggaataatcgctttggtcttatccgtgatcttgcgccggatgtcctccggatcgatattgtacgtctgcggatcaatgtctgcaaaaaccggcgttccgccgcagtacagcacacagttggcggatgccgcaaacgtgatcggcgtggtgattacctcatcccccggtccgattcccgccgcatggcatgccgcatgcagtgccgcagtatcgtttgaaatagcgaccgcatatttcgcgccgacatactctgccactgcccgctcgaactctgccaccttcggtcctgtcgtcaagaaatccgatttcagcacctttactacttcctcaatatcatcttcctcaatcgtctgtcttccgtatggtatcatcactgttcctccttgctgtacttttccagttccatctttgccctcttactgtaggaatacggaatgcccctgttttccttctgcatccgcctgtgaaaggatctaagccgctctgcactcattggatccggcatatgccatgtctccagctgcccgagaaccttctccttatccagcacgccatgtaagatcagaatgagaatggcatctactgatatgttaccgctttctaccgcgtgaatcaattcctgataatcctgtgccggtctgtcaaactccatgcgatgcagcaaaaagcgtaccgagagataggtccggcatatcgcttcacagctgcccgcctgtgccagaaacgacgatcttttgcttaccctgcgatccgtctgctcaatctcacagataatcgcaagcatctccagctcggagctcttcatctggctctgatgatagatcccgatggcctgactggcctcgtcccattgcccctggtctatcatcctgcggatcgccgctgccagctgactgctcagctgatcccactctccgctcgagaacagctcctccccctccggaacgttgaaaaattccggatactcttccatacagattttccggttcctgtcataattggtgagctttgcgaatccgcagtcgtgcaccacccagggttcttcctgataaggcaccacaatctcatagcctgccctgcggaattcaaacgcctgcgacacatcatagaaatcaaaatccgaaaacagatcctctctccacggcagatcatactgcgtcatcatcagcagcccgtccaccgcatcgacggtctgatccttggtctggttcggcccgcacagcaggacataggaaagatccggctccctgcagtccacttttcccacattccaggaagaatagacgacgccgttctccggaatgccgattcctccaaccatcccgatcatccccgtctccgggtgctccttaaaaatacgcagcgtcttctccaggaaacggctgtcgcggataaaaacatcctgatgcatatagactttatattttgcatcgctgcttcgcatccccagattgtacgccgcgcacatggaatccgcctcccagatgccgatcacatctatgtcatatcccgccggaacttccagatgctctatgtaatacttgcactcttcaaaatacagctcattattcacgcatataatgaatgcgattgtgtcttttctgtcctctaccggcatgattttctacctcatacatctcttttatactgctgcaaaaatgccgcaatccgctctgcgccctttccgtccaccagccttctcatccgctcaaagctctgcgccctcttcccggcgtctttcgtatagcagaccagattttcacagattacatgcggcgcatcatccttttctctcacatcccccgcataaattaacaggttgtgttctgccatctcctccgcaaattccagctgattgtccgcaaacgcaaaacagaccgtcggaatcccgcaggcgcacagttccagaagcgttgtaccgcccgccgagaccgccacctcgcactgctgcatgtagcgccacatatcgggaatattcttgtgaagtatgatcttcgggtttgctgccgccagttcacgcagcatgtcctcattccggttcatgcttccgacaatcacatgccacagatagtcctgcaattcctgcatctgtgtgccgtacgcaagaattctgcccgccatattgtaaggatcggttccgcccgtcgagagaagaatactcttctcccgtggcttatcaaaggaaagatgcgaaaactcctcccggagcggcgcatacaaaagtccggtaaggtactgtaccccgtccttttcatgcagcccctccggcgtcttctgtctctccctgcacggtatatattgaagcagcgccgacacctcgtagtgttcccttctgaaatcgtcaacatagaataccggcaccatccggtttaattccgccagatagcgcaccgtcgcacagtaggaatccacaaccagccagtccaccggctgtgcctgtaaccgctgcttcatgaccggaagttcgtcctccagcgcatcccagcgcgtctctagaatccgatagggaaatcctgcctttgcgatccgctccgtctctttttcctctgccagccaaaactcacacgtcagcccgcgcttcctgcacgccgacgcgatcgaaagcgtgcgcatcagatgtccggttgccacctgctcgttcgcatccacccgaaatacaatcatctgtctactccacctcacccggaagaatcggctctccgaagcggtacgcctttttcgccttgcgccccagcagcgtgcggtaatacttcggcttgataccgatggcaggccggatgctgcgcacattctcctcggtgaaagcctccccctccgcaatcggttttaccgcaaccagcgatctgcggtattttaaactgctcttctcatgttcggtcagctcataggtcgcctttcccttaatcacgcaggcattccgcacatcctgcaccatctgcgcaaattcaccgatctccatggaaaacgctgcgtccgggttgtcaatcgtccgatccaggcatacatgcttttcgatgacctgcgctcccacagacaccgccacaacatccgcaagtgatcccattgagtgatccgacagtcccaccggcacgccgaaccgctccttcatatccgcgattgttgccacattcatatcctcatactgcgccggatactggctgcagcatttcagcagcaccacctgctcgtttccctgtctccggcacgcctcaagtgcctccctgatctcttcctccgacgccattccgcaggacataatcatcggctttcccttgctcgccgtatactcgatcaatggaatatccaccagctcaaaggacgcgattttgtagaactccacatccagatcctccaggaaatcgaccgctgtccggtcaaacggcgtagacaaaaaatccacaccgacctccctgcacttatcccgcagcgcctgctgccattcccacggggtataggccgcctggtagagctgataataattatagccgtcccacagaccgcccttgatctgatacggttcctccctgcagtcgatcgtgagcgtatccgccgtgtaggtctgtatcttcacacaatccgcgccggcttttgccgcctcctcaatgattttgaatgcattctcaatttttcccgcatggtttgcggacatctctgcaatcacatagaccccgctgttcattttctcatatagtttcatctgtgacagccgcctcccttttcttttccacgttccaaaccgtttttcaacacgaatccctattctacgcgcttcgccttcgcctgtacctgaaactggtacgcgaaaaacaggttctcgtcggtaatctccgacagttccatcagcctgcctacaaattcccggtcctcggagctgactccgtttgaggtcatccttatctcctccgcttccagttccgtccgcagtaacatgctaagaatctctttgtaggtgaaaaaatggatatgggttctgtcgagcagtcccctgtcctcataggtaaaattgccgttgatcagcccccgcacaaccgagacatgcatcagattggggatggacgccaaaatgcttccgtcctcttttaaaaagcctttgcaatatgtcagggttccttccgggtctctcagatgttcgaggacatccccgaatacaatgtaatcaaaggtcactccgccaaaatccatctggcgttcttcaatgtttcccacggtcactttcgcaatacagttcgcaatctccgccgccgaagggttgatttccacaccgtaaagctctgcattgggataacggttctttaccccgagcagatttgccccgcagtcacacccgatctcgagaacacggatgggggcatcttccggatctgtgatgtaggaaagcagtccggcgttcggaacggcattaaagtagttcatgttccattttttcttcagaatctgccggtctgacactgcccattcctcgtcttcgtccgcggttctcttttccgcaatctgatagaagaacgcaccgccgctttcaaacagcctgtactgaagcttgatccccctgacacagtaatcccacatcacattctccgcaagggcaatcttctcatcaaaggctcccacttcttccagcattgcatactttagcagtacacagcctgcggtcagttccagcttctgcagattcatccccgccgcaatctgccctgcctgtatccgcgaaattgcctctgtgtagcttggcgcggtctctgaaccgttctgaatcaccttcggcataaccgcaccgattgtgctgtcggagtacagtaatctctgcatttctccaatagcatccggcagtatcatatagcagggatcaagcagcaaaatgtcctcatctgtgacaaactctgttttcgcatagttaagaatggtgctgtaattctctcttccctcatcgcagacaagataatttatgccgggtctctcttccagccactggcgcagcccgtcctgcgaagcgttgtccacaataatgagatctctctcctctattccggcaagcaggcggagcgcctctatttccatctgcactaatttcaactgattatgcgcgacaatgattactttcatattttctcctttatttaccgtctgcgttctgtccgattgccctgcggtaagaaaaaccgtagtcttctctctgctcttcatagccaagtttctgaaaaactttctgtgatgctatattatcattctttacttccgcaagcaattctctgcaaaatcctttttccgaaagctgctcctctgcggctgcgagcatccacgacgcatagccatttccccgcgcccactctgcaatggcataggatatttctgcgctttcaccccgctcatcccggtccgcccgcacctgtcccaccggtgcaccggcgtcttccagaatgtaaatcctgcagttctcattcttccgcttctgctcataccatttctgatgctgctcatagggaatctcttccgtatggaaagaacttgcccggacgagcggatcatttcttagctcgtacaaaaaacggcagtcctgcgcatccgccggtcttaaatgcagcccccgcatcctgtcctcctgctttgtttcacgcatcagatattcattcaggtaccgcgtcacttttgccgcacctgcggcgtttaagtgtgaccaatcaaaaaagtccgcatctgtaaatgccgtctgatccccgcccagatcaatcagatccgcgccgtatttgcggcagagattttccagcaccagatacgtctgccgcttcatctccccgctcgtcagctcacaaaactgcgccgggaacggcatgaagagaaacacggcctttatgttgtttttctgtaaaaactccagccagcgttctaaaaccgcaagattctctttgtatgtctcgggatacggtttgtgaaaaatacgctcgatggactttgcatcctctttgcgctgctcctttgacggcgtatagatttcctctcttttcgtctcacaaatctccgcgattcccggaaaccgtcccagaaagtcgcgctccaggaagtcctgccccatcagtttttcacagattctttggtcttcccatgcctcggcggcgtcctctgcccagtccagatgatgcagctttttcgtctgtgggtagaatcccagcactcttagactctgtgatccccgtgacagatcccaccagagccggtacgcgctcattccgatgatgcaatactccatccggcgtttttgtctgtccgtgatttcgtcatatgcccacaaaaagcggtaataatccgtgtacagatcctgcgacggtcccgccagacacatgatatcccgcgccagtctctcatagcagatgcccttctgctcgtagctcattccgcatacgacgcctgccgccgttgtgacctcttttttattttttatctgctgatacgtcgcctccgggctgatttcgttcatcagacggaaaagatcaaaccggagcagtcttaccttcccgaaccagtgtatccccgctatattttcatactgggaacatataatgatgtaatcactttccctctgcccgtccgaaatctgtcttacggtgccaagcagatgaacctgactgacatccagcagtttttccaccggcgcacagtccgccgcctcccccagaagccatacctgatatttttcctgctctctctttaaatccgatactcggccgacaatctcttttgcgcacacatcatccagccctccgccgctctccagatcccgggcgctcttctccagcgccgcaaacagcaggtcaatctgctccctgtatgccgcctgattgctcattccatctatgtaagcggctatttcacttatgatctgacatttgcgctcatatgcagtctgttcctgcagcagctcatccaaatctctcgccgtcatctctctactctgctcccaacattccggttaatgcctgttcaaatgtaaaatcgcgctgtacctttgcaaggccgttggcggcaatctgccgtctctcggtgtcatggctcaggtaatattgtgcttttgcatacatatcctcgatatcctcgtagatcacgcactccgcgccgttcacaaaatgttccgcgatttcttccctgtaattcgtaagtacaaaaccgccgcagcccataacatccagcacacgcagcggaattccggtctgtatgacccgaagcgcaatattcaggttgatctttgcgtcatgaaaaatatgcggcatctgcttatagtaatccgcatatccgtaatagtgaacctctgtcagacgctcgtccttctcattggaccacaatgccgtcgcaaagtggcgggacagcagtcctaagacaagaaaccgctctcttcccgttgtctcgcaggcaagcaaaaactccagttctctgcgggaaatgctgactttgccgccgctggccttcacatatgagtcatttaattccgccagcagttcgtccgttacaagatccggaatcagatagcctccatacacttttagctgcgctgcgatgatgccctcaaggcgtcccctctgataagcggacagcggctgtagatagtgctgatactccgtccggtataattttcccacaagcgcaatgtccgtctcgtatttttctctctccgcacgctcagaccgcgtctcatagatccggcggtacagttccgtatccaccgcaagcggcatgtgccttgcatcgattccccggctccggtactcctctgcctgtacccggtcaaaaaaataaattgtattgcaggaatttttcagcgtagcaaggttgcggatatgaatcgggcaatcatacacccacgaaatatatcgcacatcatgccgcgcgcataccgttgaaatcagcggtgcatagttgatggaaaataccgccctatacgcccctgtctttatttttgcctcaaactgctcacaaaacgcgtcatctttttcccagtccgcaaactgataacaaaaagtatcatagattatattcattttctgaagtgcacgctcaattccgtcattcataaatgaattccattgaaaataaagtatctttcccacacaatatctcctgatgatgtcctatatccaagcaaaaaaccggcttctggtcatcccaaagccggttctatgacgctttatttagttacttcctttgccgcttcgcccagttgctgaaataccggaattacattttcaaattctactgccattctggcatcatcctttgccgcaatcgcatcgcttaacgctacaatcgccgtgttaaaacctgccttgtcaacacggacctttccgtcattgagcgtatccagcgttccgttgacaacctgtatctcccagttgacggcatccacaatgcctttcaaaaactgatcggtatcgtccagacgctccccttttaactcttttacgataatctccatattatgcacgaggcggtcattgaactctgtcaaaacctccagtgcttctatctgttctgctctgttatcttccatgatctttccctcactgcacccgcagcacagccatcccggcttcctttctcataattatactgttaaatatatcggttcctttttccatttgcttaatatcttttttgtaaaaggaactcttatcaactatttctatattcttgcaaaaatttttcgcgttcaccaaaatagtcatgataatcagatgcaccgcaatcatggatacaccacggattcagcattgcaggaacagcgatcttgtatccccgctttgaaaattcaaagcattgggatacatcataaaaatcccattttttaaatatatccgctctccacggtacatcatactgtgttatcattaaaaatccgtccaccgcttccacgtattcacacggagccgcaacttgtccaaaaatatatgttccatatccttccgagccttgcgtatataaacttccaatcctgtcgccataccacatgacaccattctccggaaataccggtgaaccaaccagtcctatcattcctatttctctatttttaaacagggaaagtatttttttcagaaatttcttttccgtaatcattacgtcttgatgcatatagatcttatatctggcatcgctcaattgcattgcccgattatatccctctgccatactctctgcttctctgatcacaacactttcacacgaatagccctcaggaacctccaaacgttctatgtaatataacgcttctttttcatactgttcattatttgcacacatcacaaatgcaaactttttatcgttcataccaactccacctgaccacatatattattccgttacatatttccccaattcttgtaccataatttgaatactttcttcctgcggtttttcctcctgcattgctcgtagtatccagtatgcatgcctgtacatagacgaatcaatcataatttcaacaatgtttaccatcacgtcaaacgtctccattgctgtcgttcgaattgtctgtatcaaatataccggagaaacactgttttcctttataaaaccgatcagcttctctcctgcttccgtttccgcttcatccgcaaattccattcgccacagcaaaaacttaagttcacgtatataacttctgattttctccaacgtccatccttttgcaatattttttcttcctaagatggtatattcctctcctgctttcacttctaaactgtaaatctccattattgtccgcagttcaatgattctattatcaatgccaatatacggtttcacaatctcttcatttaaatataattgcatcaattcttcccgtgcgtgttcatcgcctttttgcaaaagcaaattcgtcttttctaataaaacattcaaatcaccactatggcatgtctcccatagcatatactctttctcacgctctcttgcatattcctcagatgtggtgcacagcacccgttccgtacccttctccccactcatctctttctcctccatgctttcgtaacagcactctgcatccacaaaattttatacataaagttcaccggcagataccttttcacagaattcctccacggttcctttaaaaccgaccctttggagctcccgcttcaagtcttcttccatatgccggtagaacggataatcgtggtcggccgtccccttcaccggaaccatatagtctccgtattccgccgtgagcacctcatcatatccgcacggcgccggaagcctgatatgttcaaacggcaggtataccgtcttttcatacgccgtcttagggatgtgcagctgctcccggttgagccagaacacgtaatttgtcacctcgtccgcttcctccctgcggtataacgcctgcacggcatccgtgatacgccatatctcattctgtctgtctgcatccggggcaatctgaataccgcatagttccccgaacacctttattttatcttcaagtaaattttcgttctgaagctgctcccagtcacgcagcagggcaattcccgtctccacgatttttttctgaagccggctcaattccggatctctcgggacataatccatcgggaaaatatctattcctatgcgctgatacggaaaaccgtgaaaacgctgcatgtacgtgttgatgttccacatccgttcatccgccataaccctcagatgcggcacatacgccgccatctgcaggcgcttttccccggcgtacattcccgccatgcaaaatccctgcggcagctcctccggcagaacccggatcaactccatgtaatcctcccggagcatacagatgtcaatatcatcatcccacggtatgaatcccttgtggcgcaccgcgccaagcagagtaccgtaatccgcaaaatactgcagatgataccgttcacatacatccgcaatcacgcttaatacttccagttctgccgcccaggcgcgcttcatcattgcgggaatctcaaaatcgtctctcacttccgcgcaaaaatagttctgtggaaactccattttccttctatctccttacctaagaatccatcctttgcatgtatttacatgccaagccggtatttcacttctgcaagcttccagtcctccggcgtgtcgatatcctgtaccttcatctcatccataatgtatggtatggtgttgtgtaagaccatgctgcgctccttccggaatgcttctacccgtagcagataaaactgtccgcaatcatgataataccgctccagatcctgcgagcgcttcaagcggttctcctcccacttgtatttcaccctgtcctgctcaatgacaaagcatctctgcggcgggaaggaatatgccacaaccggaaccaccccgtctgcccccgtctgctccaggcgctccatgctctccctaagcacatccgccgtcagaaacggcgccgtcggataaatacagcacactttttcaaatgtcactccacgcttttcatactcttcgagcacttccagaattacttcgtgcgttgccgcataatctccggccgcttcctttgaacggtaaaacgggactgctgcccctgcccgttttgcaatctcggcaatctcgctgtcatccgttgataccatcacttcgtcaaacacgccgctctttaatgccgcctctatcgaatactcgataataggtctcccgcagaactcctttatattcttgtgcggaatccgcttgcttcctccgcgcgccgtaatgaccgcaaccgcattttttcgctccatatcgcttttctcctcctcttatcttacatattttccgcgagccgtttccatacccgttcgtccaccacttcatatgccgctgcaaccgtttttattgcacagacggaataattcttcaggatgtagagaatgtccggttttccctgatccgcaccgaattccactctttttaatctgtatttcagatcatttatcttccggacgagctcctcacaggtctctcccgcctgccagaaccgcatctcgccctccgcccgttcgccgcgcgcaatgtccgccagtatctcgtattcgcgcagatgcagataaccccggttgttcgggtcggaaaagatttctatcagttctccctgatttccagcgttgaccagccgtttcagttcctctctcgaatcctctctgagtctgtcatattccctgcgccttgcacttacctcgcctgccacaaacggtttgatgtcctgatactccccgaccgctctttcacagtatttgtaataattcagcattttgctgtatgtattgtcatgataacaccacggactatcctggtacggcactaccacacggtagccggcccgccgcatctcaaagcactccgaaatatcgtaaaagtcccatccatcaaacagatcctcccgccagcgcacatcatgctgtgttgcgagcaacagtccgtccactgcctccacgtcaaccggctgcctgtctacacgctgtgtgtactgcaccctggccgggatacagttatggtagacacatccgacgttccatgccgcaaccgcctgtgcattgatcgggacatcatcacatccaaccattccgatcaccccgatcctgtcatcgctccgaaaaacggagagcatgtcctgaaggaactccctgttgatgatgaatgtatcctgatgcatatagatcttatatctggcatctgtatgttccatcgccatctggtagccggctgccatagacggtgcttcccgcactgcaatcacatccagttcatatccgtccggcacatgcagacggtcaatataagaaagcgcctgtgcatactcttcctcattgttcacacaggtaatcaccgctattttcataatcgttgccatcctccctgtttttttatataatcttatcagacaagtctcggaaaggaagtacatgcaatgcatatcctctactacagttggcaagaaaatacgacgtcagattttttattctccatgcaggcgctgggacatcaggtctccccctgtatgcatgagctttcctattacttttccggcggcgtcaagtccgacatccgggaccagctgcaggcgcagacctatgatgcagtctttacctttaactttttcccgctgatttccgatatggcggagtcccttcacataccatatatctgctgggtttttgactgtcctcactatacgctttattctaacagtatgcgcaactcctgtaactatctttttctgtttgaccgggatatgtgccagtcagtcatccggcgcggtgccagacacgcattccatcttccgcttgctgtcaacacagcacggcttaaggaacagcttggcatttcatccgaaggcggtctgctccgtcccgatacttacatgcacgatatttcatttgtcggctctctctatgagagttcccattacagttccttccgctacgcgccgaaccatctgcgcggctatctggcaggcatcattgctgcccagaaggaagtgtggggaatcgacctcatctcgccggttcttactcccggaaggctcgcggaattcaccgctttcatgccttattccggtgcggaatatgaaatgctgactgcaaaggaagttttttgcagcatcattcaaaaggaagtcacctcacaggaacggatcgaagccgtaaaccgtctggcggcttcccattctgtcgccctctacaccggttccgacaccgcatgctgtccggatgttctctcaaagggaacggtatcctacaccgcggaaatgccggatgttttctaccgttcgaagatcaacttaaacctcacgctgcgctccatcacttccggcattccgctccgcgcacttgatattttaggctgcggcggttttcttctctccaactatcagccggaattatgcgaatatttcactccggatgtcgattttgtctactttaacgatatggatgatctggagcaaaaggtctgctactacctggcgcatgaggaagaacgctgtgccattgccgcacatggatacgggcgggcctgtgatcttttctcctatcacacccagctgacccatatgctgaccgtctttgccgcagaatccaaagactgctgattaccggttgtcgagcagttccaggaactgctccgcccgcttatcccaggtatgttccctccgcgtcttctctctgccgctctctgccatccggcatctcttttcttcatccccaagcacgttctttatttttcccggcagttcttccagatattccaggtcgaaaataatcatatcattctcatcatacctgccgggaagatacccggtgttatccgtaaccagcacggctcccgccatcataattcccgccatccgttccgtaaagccgctcttgtgccaggacatcacatttaaggacattctggactgtctccacacatgaagtccctcctccacggtgactcccgggtggcagatcagattgggatatttccgaagcgggcagtgcgtccagctgtcgccaaacacatccagccggattccggcctgtaagatcgtctcgatcacacggtgcctgtaatagtgcatcgcgccgtaaatcacccgtctgaccgcatacattttttccacaaattcctcatccgtcagctctatcccgtagtgctccagcgttctggaaaacgccgcctccgcggtcaggttgggatatttccgcatgacaagcaggaaacggttcgccaggaagcgcaacggacgttcctgttcccggatccattgcagctgcatctcatacccgccataggtgccgacgaatgtcaggtcatagatccgctctatgaaatcctcccccgtctccattcctgccggcgggaaaagaatcgcatcctgtttgtagaagcgccggaagaaatcggcatatgtctgatccagtaccagcacatgaaaatccggataatgatgttcaaagtgcggctttccccagatcggatgatccaggaaaaaattgtacttcggaccgtatatgtattcgtgcagatagtggacctcgtcctccatcttaatcgagaacgcacaggactgtaccccgatcaccgccttaaaatgccttcccttaaactggataatttcacgcggatcgtgttcttcctgatcgaaataaagaacccgctctcccctgcgttcaagagccgctccgagctgttccgcaaagatcgtgagtatgttataacataccgggtctcccttgtagatcagaatcggctgtgctgcctcatcgatccggtaatattcctccttatgcccgatcatcccttccagataggaaaccgtctcttcatagcgcccttccatctgtgcctccgcgagcaccgcctcgatggcagcattaaaatagccggcttcctgcagctgtgcgctgtactttcccagaacgtagcagtccgtccgccagcccagaccggtattctccggcttctctacatcgtcgaacacaatcctattctcctgtccgcacgcgtcctcgtctctctcctcaagctcaaccggcgtctctgcggcgatccgcagcagcagctcatatttctgctttgccccgagtcttttattcaccccgcctgccagacgaaccatctcacgcggaaccgccacggttccggcacagattgtttcgtcaagcagaagatccataaaccagttactgttttgtgatttttttactgtttttatcattctcaaatcctcataaagtctactttattatatcggtatctgcgatccatttattaactttccctccgtctaaaccgatataaccttaagatattataacctcagaaaaggatattttttatgaatcatacgcctatcaatctggtcatcgctatcaaccggctttatgtaaagtacgcctatgtgatgctgtactcttttttatgccatcacccggaacctgtatcggtctatattctgcatcatgagcttacccccgaggatgaagccaccctgcagacattaagtcagcagtttgccgtgcatatatccctggtgtatgttccggattccctgcttcctccacccgaagttcttaaaaccagcagctgggggatcgaagcctacttccggcttgcgatcacagatcttcttcccgcttcggtcgaccgtgcgctttacctggataccgacattattgtaaatgcgccggtctatgatctgtatgagttggattttggttcaaagcttatcgctgcctgcaaagaatttacctgccatcccccgttcggaaattaccgggatgttttatttgcaccgctctttgaacacggtttttcctatttcaactccggcatgattctttacaatctcgccgccctccgcccggactattccttccagacctatatggatacggcaaggaaactgcattatgcgatcgaatatccggatcaggatctcttaaattactgtcattaccaggacacactttttgtcgatccctttctgtacaatctgaatgcgcgatacggatatgacgactataatatccattacgacgaattaaagcagcggggtgtcatcattcactatgcgtcctccaagccatggcgcggcaacttcctacactatgacatcgaatggctctggtgggaatacgcaaaacacacgccgttttaccgccagttattggaggaggccctgcgcgaaaatattatggactccccgctcaatccgtacattgcggatctggcgcaaaaaaacgccgcactctaccagaaacttgaaacctacgaacagcttttagaaacgcacggaggaaccatttcatgaagcccgaaccaatgaacattgcggtatctgtcagcaaatactatctgccatacacctatgtcatgcttcattcccttctgaaaaataatgcatgtcccattgacgtctatgtcctgcatcgggaactgtgccctgccgattttgattttttgcgcacactgacccacacgcatccgcttgtcataaacgactgccggctatcggaggatcagattccgctttccgcagatgacaacgctgcaccggcagccccagagagtctcttttatctgtctattccccggattctcccggcagatttgccgcgcatcctctatctggattccgacgtcattgtcaatgcccccctgtccgcgctgtatgcagccgacctgacgcatcatatgctcgctgcctgccagacagcgtccggcattgcagacggggtactgcttttcaatctggattgtgacgcatcctgggagccatttttcctgcaaaaagaactttccgctgttcttccgcttgatcccaaagtctacaacctgcccgcacggacagcgtataccgcacacaatctgcactatgagaccgtccgcacgcaggctgccatcgttcatttctgcggctccaagccgtgggagggcaactgttttcactgcgacatcgaacagctctggtgggattatgcgaaagacgttcccttttatgaagatctgatggaacacaccctgcatgagattgtgacagatccgacagttatcaattatatcagcaatctccggctggagcataagcagctgctcgacattatcgaaaaatacgagatcattttagaaagaacgagctgtcgcgataagcatagcccccttttgggtgataagtaatactataagaagaccacatcgtgggatttcagatggaaatgcagatggaaattcgttggagaaaaatgtgagcatttcttccggctgaatgtctgcatcggattccgtgtctcttccacgtttggacaatccgacgggtgcatgtccgacacaccggagacaatgggcggactttctggtgtccctaatggcacctcttcacagacaatataaaaccgcgcgaaccgaaactcgcgggcatctgctattgaaaataaggcagatgccgactcagacatcggcttcgcgcggttatgttttgctcagaggtgccataagggacacgcacaaaagtcctacaaattgtcttccgggatgcggacatgacccgcggagtgctccaaacttggaaagacacggatcatcgaagatgcagacatccggtcggttagaaatgccatattttttgatccgaatttccagttgcatttccacatgaaatccccaagtgtgtttcttatagtattacttatcaaagcaaggtatgcttagcacgacacaccatcttttatcttctcctccagcttttcaatcgcttccccaaagctttttctgctgtcgagcagttccttcgcacgctccctggcgcgggcggactgccggccgtaatatccggcatcatccatgtagcgcaggatctcccgctccatctgttcataatcacgcacgcgaaacgcctcgccggctgcagccgagacatctccttcgggcagcgtcaccgccggcagtccctgatacagcgcctccgccacagagcttccgccgcctgcacgtctgggattcacatagagatctccgcacgcgaaaacggcgagcgcatcctcctgtttcccgagataccgcgtatgcttccacagtctctcatagcccgtctgtatgctttgccaggactcatagcgtcccataaagactacctgcacattctctctttgtgcggcaatccgatccagcatcgccagaaaatcatcggcaatttccgaatccagccgccatcccacgatcatcaggacaaatccgtgttcccagatccccagctcctgtctggtatagtggtgttcctgcggcttaaatacaaatgtaaatctggcagcagctattttttccgcatccactcccaggcgttccagcacaggcagatctcctgttcccggctttccgtccagcaactggtattccccacaggacatcgccaccgccgaaaaaaccgtccccaccgtaatctccggcacgaacataccgcaaatatccgcacagatgtcgcttcctccgatatcgagcagataacagggcttccgctcccgaatcatctgcaccagctgtaccatcgtatccagattcggcatatcattcgcacattgatgaaactcgaacacttctccctgaaactcgatgtgatcaaagctgcacaattccggcagatagcccgcctcacagagatcgtagaacggccccgcaccttttccggaaatctgcatcgccgtgttgatgatcacgaccttcttcctcaggtacttctttagcaccaggcaacggtcgagcaatgtctttgtcggcgcatggttctggccgagcacctgtgaggtcatcacaaagaccagattcccgtctctctcctctaccggaacatagttccgtcccttgattcccagcgccccgcagaaagcatcaaacagcatccggtacagcgccgcgagctgttcctgtgtccgctcccctttgagccgcgcatcggcaaacacagccgtaccaatctgccagtaatcgctgagcttctcatattcccccacttcattccagtctgcatccagcactgtttgcagcagctcctgcgtataagccggcgtctttgacactttcatacaaaaagaaagcagatgtatccgcatccagacaggtgcttctcctgcctggtgctccatctgctccaatatcatgctgcgctgcgattcctccagcgttcccagtattttctccaaattatgaagccgttcttctatctgtccataacattcaaaatattcctgcctgctataacggcagatttgtccgatgaatgttccgagttccatattcgctccttattttggcgcacccgcaaaaccattatttgattcgtaccggtatgccccgctctcccagatattcctttgcctccctgggtgtctgttccgtaaaatgatagatgctcgccgctgcaaccgccgatgctccgccctgcgtaattgcctggtacatatcttcgtaactgccggcaccgccggatgcaatcaccggaacattcactaactctgtcgcgatctttatcatctctacatcgtagccctgcatggttccatccagttccaccgaggtcagcagaatctcaccggcaccggcttccacgactttctggacccattcttccagcgaatatcccgtgtcaacttcgccgttatgcgaaaaacagcggtaggaaccgtcgatcttcctgcagtctatgcttgccacaatgcactgtgatccgaataatctggcgccttccgttatcagttccagattgtcgtacgctgcactgttgatcgcaactttatccgcaccggcccggaggagctgccggatctgctctatattacagattccgccgcccacgcagaacggcacaaaacactctctcgaaaaatcacggatggactcgtaatccggatcgcgcccctctttggttgcctcaatatccaccaaaatgagctcgtccacctcgcgcatgttgtatactttaatcgccggcaataccgtatccactcttctccaggagttaaatcccacacccttcaccaggcctactgatttgtacagcaaggtaggaatcacgcgaacttttaacatctctctatctctgctccctttctctcttccgtcacatcgccagaaaattcttaatcaggcgaaaaccggctttctggctcttctccggatgaaactgcgtaccgacaatatgatcttttgccactgccgagacaaactcaccgcagtacggagtaaccgcggcaatattctcctcatccctcactttaaaatgatagctgtgcacaaagtagtagttcgttccatcttcaattccatcaaagagaggcgtttccacgcgcttttcaatgtcgttccatccgacatgcgggattctttccttcgcctgtgtctgttcaaaacgcacgatctcgcccggaatatatcccagtccctcgcactcgcagacctcatagccccgctctgccagcagctgcatcccaagacagattccaagaatcggtgtctctttttcaagcacggcgcggtttaattcctcaatccatccgccgtctcttagattattcattgcatccgggaaagcgccgaccccgggaagcacaatatgctctgcctccctaaggtcgagcggattatcgatgattaccgcatccgatccgcatttttcaaacgctctctgtacggaaagcagattgcccattccataatctataatgactgtttccattatttgttgtctttctcttctacattgtcatagtttatcttggtcagattaccgtttttatccttgatcagcttaccattcttgtccgtcaggaaaagcttcttgttcgtaaactcatcgcagatcttgataaactcgtctaccgtaataccgatcggctcgaggatatcctccagctttttgtccaggtaagtccagcggaatgcgccgtcgcgctcctttaccacctgcattgcctcctcacgggagatgcgtcccctgcggatatgcatggatgcctgatccgagcagcgtccgaatccgaacttcaggtacttgaagtattcatggattcccgcctgatagttatcgagattctcatagtcgtcataatcgccctcgaccactttgccccagctcttaaatccgtgcgcctttgcaaccagaacattgtggaggccttcccacggaatgtagtatcccaggaagattcccgtcacgccgacgcgcttcaactcttcatccgtcggatacgtaaacggaatcagatcctttttcgttatgccttcctgaccgatcaggtcattcacgcggagaccgagcataccgccgaactcttccagccatctgcggtccagcacgttattttcaactgctgccgccggtccgccatactcgttctgcgaattctctccccagataatcagcgggacgttaaagttcaccgccatacgcaccggtaccgtgaaaatgctgacatgctccggccaggaaatgtctcctacctctgtcagtccgatgcggttgagcttcgcacgtaccacacggttggtcgtcacttcgatgtaatccacacccatctttttgatattctcgatgttctctcttccgatcggtgtaagatcgcaggttgtcgcggtcacgcagagcgggttcatgcccagctccagcatggtaattacctgataggtactgtcttttccgccactgaccggaataatgcagtcccagtttgagtgatccttggaacgatagcggtccagaatctccatcagctctgcttttctctcatcccagtctacggatttgcggttctcataattcctgcaggcattacagattccctcttcatcaaaagaaagatgaggtttggtacttggcaggcaacatctcttgcaatatttaatcatgattgatttcctccattagtgttctttcacagtcttaagcatttcctgaatctgttctaccgacagccattccgtgttggttcccgagctgtactcaaagccctgctccacacgcttgccgcctgcctggatcttggaatcatcccaccactcgaagtgcggatatacaatgaaatgcttctcatattcgtaggtcatcatggagtcctcacgcgtaaccatgatctcatgaagcttctctccctcacggatgccgacctccggcatctcacatcccggcaggatcgcctgcgcgagatctgtgatcttaaaggaaggaatcttggaaataaacgtctcaccgcccttggcttccgacagtgccttaataacaagctgcacgccttcatccaggctgatccagaaacgtgtcatccgataatcggtaatcggaagcgccttctccccgttctctaccagattacggaagaacggaataaccgatccgcggcttcccgcaacattgccgtaacgcacgatggaaaagcagacatttttggctcccgcatatgcattcgcggcaataaagagcttgtccgatacaagctttgtaccgccatagaggttgatcggatttaccgccttatctgtggacagggcaaccacgcgctttacgccgcagtctaatgctgcatcgacgatattcatcgctccgttaatgttggtcttcactgcctccatcgggttatattcgcacgccggaacctgctttaatgctgcagcatgaacgacataatccactccgtcaaacgcacggtacagacgctccctgtctctgacatctccgataaagaaccggagcttatcgccgtactttttaaatttgttgctcatgataaactgcttatattcatctctggaataaataataatcttcttcacatcataatgatccagcacatactgcgtaaacgcatttccgaaggatcccgttccgcctgtaaccaatattgtctttccgtttaacatatgtaagcctcctactttcccgcaacatcctgttgccatatcatagtttatatcgaactttttgtccgttctcataacctctattcatactgaaaatcgccgccgtcttccatccattttacgatctgctccccgcggtgctgccaggtatgatgtgccagcgctttctgataccccgcttcggcaatttccgccgcccgttcctcatgctccagaagatctttgatttgaagcggaagctcctccagtctgttcagcgggaaggtcacaatctccttttcaggtaccagtaatttgctcaacagcgtgtactcgtttgtcacacacacggctcccgcaagcatcgccgtaaaaatgcgctcatgcatgccgtccagtatgttcgtattgttgatcacaatgcgcgagcgctgcatcagctttatcacttctgtgatatcgacgccctctgaggaaagtatttccagattttccctgcccgcgccgtcataggcatcccatccagcaccgaccaccgcgactttcagaccgtttgtcaggagtgtctctatgatgctctggcgcatatagtctctctggtactggtccagcggttcgagcactttctgcatcgcaaaaaactcatcctcactgtattcaaatccgatctcccggagatagttccgcacttcctctgtccaggagctcgccagatgctctcccacaatgcggggcattacctgttttgctatggttccgaacacgcccggtatcgcgtcaatcctgctctcggaatcccgcagcggtttgtacgttcccggaaaaaacaaggcaatgtccttcttgtggtacggtacccggccctccggcagaaatccgccatgatacagcgtctccacccgctcgaactttgaaaattcctcccgcagctgcgccgcgtgcgaatcgcgcaccatcagaagacgggcgtttgttcccaggcttccccagattcttttctggtggtacaccggatcgtccacaatccagccgacacgcttcatctccgcaagttccggcagattttcgctttccagattccacaggatcgcctgtatggaaaaataaaatgcatactgatcccggtgttccagacattctataaacctgtcatccgctccgggttctgtcgccccgatcatatctacctgatatccgcatttgcggaatccctcacagatttcatccgccgctcttcccagtacgtcatacgctgaaatccctcttatcaccagtatctttttcatgagccgtctcctcatttcttatccccgctgacccttgtcagtgtgcatgtaattattatataataatcatatatggaattcaatttttttgatgattgaggaacgatctatgaatatattgtgttaccgctacggcagcattgtagaaccggatataatcgacggctttaaagaacttgggaatcaggtctctgagatatgtcttgaaatctacaacaaaaacacaactccgctcgaaggactgaccgcactgaaggacgagctgatgcgtcacagttacgacttcgtgttcagcatcaatttttacccttttattgcagaagtatgtaatatctttcagatccgctacctgtgtctgacggtggacgctccggtgctggagcttttttccaattcgatccggcttccgtggaaccgcatttttctatttgaccgcgcgcagtacgaggattttcatccacagaacccggaatgtatctttcatcttccgttagccggcaatcctgcccgctacgcacccgtcatcaggaacgccacccccgatctgatccggaaatattccgccgatatttcgttcgtcggctcattatacaccgagaaatgtccttacgaccggcttcagaccgaagatgcgtatctgaagggctatctggaaggtattatggatgcacagatgcaattacccggctgctatcttctcgaagaactgctgccggacatcatcgttgattctttccgcgatgccatgccgcaattctacattccgcctgagaattccaggcgcgatgaccgtgctgtggctgcgcagtactatttgtgtcccaagatctcttccacagagcgcatctctatcatgcgctcgcttggcagccgctacccggtatgcctttacacgggaagcgacaccaccgggcttccggtcagaaactgcggacgcgtaaagacgcacacccagatgcctcttgtatttgcgaacagtaaaatcaacctcaacattacctcccgttccatccggactgggcttccgctccgcattttcgatgttctcgcatgcggagggttcctgctcacgaatgcacagagtgaactgccggactgtttttcgatcggcgaggatctcgactgcttctcttgtgaggatgatctgcttgccaaggtggaatattacctgtcccatgacaaggaccgtgcagagattgcacacaatggttttgaaaaagttcaaaaataccacacttacccggaacggctgttgcagatgattgcactggcttacggtctttcctagacggaggattttatgcgaattttatttttagactcaccggcttttgccaaacaggatatgatagacgcctttaccgcctgcggcattacctgcgacctcttttttcatgaggcgtacaacgacaggcagaatgtttcttacgaggagaagtttgacgccgccgtttcccgtttttcctacgattttgttttttcctttaattattttccaattttgtcaaactgttgcatgaagcatcatctgaaatacatttcgtacgtatacgacagccccttggtcacgctgtactcctacacgctgatcaattcctgcaattatgtatttctttttgacaaggcgacctatctggaattccataacgcaggaatcccaaccgtatattatcttccgctcgcggcaaacgtatcccgcctttctgccatgaagtgcccggacgcactgcttccgcaggtatcctccgacgtttcatttgtgggatcgctatacaacgaggagcataatctttttgaacggctgaacggtctatccgactataccaggggctacctcgattccattatgctcgcacagcagaacgtctacggctacttttttcttgaggatctgctcacgccgcctatccttgaggatctacaggccgcatgcccgtaccagccgcttccggacggcacggaatccgctgcatttgtatatgccaactacttcctgtgcaggaaaattacatccaacgagcgcctgtcactgctgcgccttgcctccgaccgctttccactcaaattgtatacacaccatcccagtcctctgctcccaaaggcggagtacatcggtcccgttgactattacgacacgatgccctacatttttcaacacagccgcatcaacctgaacatcacgttaaagagtattcattccggcattccgctccgctgcatggacatcatgggcagcggcggtttcctgctgacgaactatcaggaagatttcctggatgattttcagccgggcgaagatctcgtattttatgagagcgaagatgattttcttggcaaaatcacttactacctctcacatgatgctgagagaagacagatcgcggcaaactgccttgggaaaatgtcggaatcccacacgtttgtccaccgcgtcaacgctatgttgaatgttatctaaaaagaccgccgcataaaacggacagtcgctttgacgcgctaagtaatatgaggagaagaacatgcccttcgatttcagatggaatgcatctggaaattcggatcaaaaaatacggcatttctaacccgacgggttttgcatctgcgatgatccgtgtttttccaagttttgagcactccacgggtgtgtccgcaatccgcagacaattttaggattctcgtgtgtcccttgcggcactgatgaacaaaacataaccgcgcgaagccgctgtctgagccgtcatctgccctgttttcaatagctgatgacggcgagttcggttcgcgcggttttatattgtctgtgaagcagtgccgctagggacactagggaatctgctcattgtctgcggtttgtcggacacattccgtggattgtcaaaacgtggaagagacacggaatccgatgcaaaagcccgtcgggaagaaatgcacgcatttttttcaatgaatattccatctgcatttccatctgaaatcggtgggatgtgtttcttatcatattacttagcacctcaaatcaacctcccgttttatgcggcagtctttttaggcatacatttcaatgtcttccgtcagaagcgatacggctctctcatatccctgataaagggtataattcttctctacaagttcctcgattcccatctcttctttttgatagatttcatctcccagcgcatattcttctgtctgcgcataagacaccatcataccaaacagcggaagctgttccagttcttcgttgtgatccatcatacgcttcaggtctggcatcagttccgccacagaccgctgctggcgcagttcctgcagcagcttctcctgtatcgcaagtccctgctttacctgcgtgccaatgctgtcaatctgctggcgcatcttatgccattccgctgccagctttgtcttcgtctccgccgaatatgcatccggaatgttcttctcaatctcctcgaacggaagcggtctactgcaatattccgcgacgacatctttcaatgtcataagccgggttccctcgatgcgtgcgcctccctctgtcgcatcgataacctcaatcagcccctcgttcgcacggatcgccttctcaaaccattttttgtagtaccacatctggaaatccgtctctaacatggttccgtcaattccctcgacctggatccggtttcggctctttatatattcgtcattgtcgccgaacgccccttcaattcccgccgtatgtgagattccgccggtaaacgccatgtcctggccgatcaggatcagcttgcggaagcccagatagcatgcaagcgcaaacgccgtcgcagaaacgcagccgccggacggaatatccggaaacgggtactccatgttctcatccaggatctgattccagcgcttttcaaaaaagccataatagtacacccgcttcgcacagtgttccaatacccacggacgggtaatgcggttgcagcaccatgccagatccgtcacatccagattttcaaagaaacggtccggggattccgggtcaatcgtacacaccatgtccggtcttacgcccgcccgcagcaccgtgcgcagcgcggcgtcaaccaccacaataaatgcctttccctgtgcttttttcaattctgaaatatttttatccagggacggtccggcggacaccagaatcgccggtatctcctcgacgtttaatccctcaagtgcctgcctgatctggtaaatatttctgcatccgatcatatgtttcatattgtacagcgtatgctgcggcaccatgcgttgaaaggtcagccgcgtgctcttgtgtacaatctcttcctgcagacgttcctgtatcgcatccatgaattcctcgcacgcatcatggtacaagacatcatatcccggcagaatacaaaattccataatcataaaattcagatcctgcagcgtaaatctcataatggtttctatatccgccgtcaccccgggaacgcagatctgcagtctgtcatccgcaataagatccgacaaatccatgacacagttcaccagataaaaaaaggaagcgtttggctcatacacgatgacatgattggtgtcgtcacactgcccaagcagttcccggatgtgtcgtccatccgacaatccaaacacaaaataggtctcgtaaatccgcggcggataccgctttgcatagcagcttgccgctgcttccggatccagtctgctgtttaaataccagaccctgttcgtcgtctgaattccaaagatcttctcctgcttctctgtctctgccgttatgatattgttatctatcgttatagaataaagctgttccagaagcgctttatttctctgtttccatgctttttcattcttatcgagcaatgtcatctgttcgttccccttatttctccggactctgattctcttctgcttccaggcaaaggatcatttcctctgccaatcccttcaggcagtccgccatccccagcatatcctgagcctgatagttctcgattaaagtttttaacacttccagaaattcgagcgcacgcgcactgtctgcccctgcatagattgcctgtatcatttcctgaaactgcggcaataaattgcggactgcttccaatccatcctgccccctgttctggtacaggcactcggttgcatgttctatgtctgttcttaattttacagtatccatcgattatgttcctctatcttactcattcgctatctgacctttaagctgaaaaaagccggcagtaaactgccggcttttaaatttactacaataatgattactgtaataaggataatacaccctgagtagactggttagcctgagcaagcatagactgtcctgcctgagcaaggatgttgttcttgctgtactcaaccatctcttcagccatatctgtatcacggatacgagactctgcagaagatgtgttctcagaaatgttgtccaggttggagattgtgtgctcaagtctgttctgtaatgcacccagcttagaacgcatagaagatacgtagctgatagcatcctgagctgcagacattgccttaccagctgcagagaaggaagatactactaatccgctaacgccaagacctgtagcagacatatcagagatatcgattgtgatagcctgtccgcaaagggaacctacctgaagcttcttacttgtgaagttaccatcgatcaggttcattgtgttgaactgagttgtagaagcgattctggtgatctcagatgctaactggttgatctcctgctgaactgcagttctgtctgaggttgtattggtatcgtttgctgcctgagttgctaactcattcatacgctgtaagatggagtgtgtctcacttaatgcaccctcagctacctgaataagggatacaccatcctgtgcgttgtcagaagctttatttaagcctctaacctggcttctcatcttctcggaaatcgtaagacctgctgcgtcatctgctgcgcggttgatcttgtaaccagaagataacttctcagaagacttagcctgtgcgcctgttgtgatacctaactgtctgttagcgttcattgctgtaagattgtgctgtactaccataattgtttcctccttgaatatgatgcagcatccatgctgcatgtgctttgtaatgtggtttctgcctctcccggccgtacgctccgcttaagcttccacctcaagtaacaattgttatcttgtttacttgtaatatatatcggacgaaagtcacgatactttatagaaaaaagaaaaatctttttactatctgcaattattttttattatccgtaaactgcggctccatatagccggacttcatcatgctcttgtaatactgattgacgaccttctgactcttgcgcacttccttgacctgtttgcgcacagaggcaaacttctgcgtcatcagatctttgttgcgcgcctcctgcgcctgaatcgttgcgctcttatcagtcagcctgcggatgtattcctgcatttccgcaatctcttcgcggtattcctgctgattggtctgcagatctgcttttatcttatcgtaaacctcctggaatccggcgtcaagaagctccaactgttcgatctgctttgctttttcctccacgcaggcgtcaaagtcatccggatcaagacccggattctccagttcttccttctgtcgtatattcagttcaataatcgcatccagaaccgcactttttttcttcaggctctggatcatgattgtaagatatggattcttctccattcgctgctcctgtcaatctgctgtaaccgacacaccgttgcttctatcttgatgcatgtgccgttctcataacttccttccatgtatcacgcatggtacgaagatgctttagcacctcttccatgatgtctttatcttttttgatatttgcctcgcgaaggcgcatcaacagatagttgtagacctcgtcaaaatcctttgccaccggatatttatggtcaagtgtactctgaaactcctcaataatacgctgcaccttcataatattattgtgtgctttctgaatatcattcgcatcgatcccctcgatcgcaagattggcgaatttgattgccccctcataaagcatcaaagtaagttctgccggggaagcggtcataatcttgttattggcatatgctgcatatccctgatttgctaacataatggttgtcctccatacatatattcgtctctgccggtgcttttatgcactcagcagagacgctttcacggcattatgccgtctaatttccaaacagactcgacagtgaggatgtctggctgttcagcttggataatgctgtttccatcgcggaaaacttattgtaataataatcctctttgtcctgcagtttttcttcccatttcttgataagatcggtataatcgctgtattctgatgccatctccttgtcattatataccttgtaactgctgcttaaggtagatgacttcatcttctcgccgactgcatcatagagaccgcttgtcagctgctgcataaaggaaattaccgtatccggatcagaagtgatcatcgccatcagcttgtcggcatttccggacgtagcggtgtcatcctcgtccccgtcaatatggtatgcatattcctgattctccggcgcattgaagtagccgagagtcttaatgccaaagttggacagataataggtctttccgtttacctcatagcccttgctcattgaggatgtcatggcattcatgactttttccagactctcatcacggcgcagcagggaatccttgatcttctgctcccatttctccacctcggaatccgagagagcatctttctcatcatcagtcaacggctcataaccctttgcggaatccgcattgtagagtgatgtaatctcattgatcagcgcattgtactgtgtcaggaaatcctttactttatcgtaaattccctgtgtatctgtcgatgtggtaatagaaatcgcattcgtatctcccgcaccggttgcctgcaatgcagtgatcgacagaccgttgatggtatatgtattgagcgaactggtatatttgattccattcagaagaatctcggaatctgtaccatcgatcttcttagcatctgaattgtacgttatgttcgtgccgttctgaatctcatgggcactctgcacctggctcacaaagtctgcaaatgcggttgcatactctgcagatgtctcatccatcgccgcgagcttcgacaataccgcattcttatcaatggcatcctggtctgccttcatggctgtcttgttggcagtaatctgtgatgcgtaggtattggtaagcgtcgtcacccccgctgaaccactcgccgcataggcattctttaccgctgctgcaatgctcgctctggaagcactgtcagcgctgtctaacgtatcctccgcattttcaaacgcattgactttctcaacatttgaggtcatcttgttgacaaaatcatctgtcagggtgtccttgtttgcttcttttaaatctgtaagcgcatctgcggcacggccgatatctgttgctgcggctttctgatgatacaccatcttctggatttcactctgtgtgcaggcagaaagtgcaactgtcttgccgtctgctacttcattaccgtcactgtcgatctgtaccagattgccactgctgattttgtatgtattcccgtcagaacctgccagagtattgttgtcattctgtgtgtaggtcacaccattgctgtctgtatacttgtaataaccggttccacgcgattctgcggttacctcatagtaattggtgttctccttgatcgtggcagtgttcaccgtaccgtcatccgccgtatatgaatacgtggcattgccgtctgtgtccttcccgccggtcgctgtccatacatgaccgtcaccgtctgtgtaagtaccgtcgtcattcttggtgtaaacgttgttgctgccatcttcataggtaaccatcttgcggatataagtcgtatcaccgttctcatccttatagctgtaaatggtattaccaagactgtccgtatcggacttcgtgtagacatttccgtttgcatccatcagggaatccactcgctgggatgccgtcattccaagcagtgtctgcagcttcttctgatctgcatcggaaagtccgctgctctttaaggcatccatcattgccgaataagcgctggcataaccataggatgcggtcagattggcattctgtgccgactttgtcttgtaatcctcctgcgccgccttgtaagctgcgatcgcatccgtgatattctggttaagtttattgccatctgcatcataatactgtgtataagacgtataggtggcatcggttgccttggactgtacattcagccccagctttgtcaatgcactgataccatctgcatcgccgcctgtaagtgtaaaatcattatcctttccggtgctcttggagctgataaagaaacgatggttcgtctcatcgtaattcgcactgacgcctgcgtccttcaatgatgcaaggaagcccgcaaccgtcgtcccctgtgttaccgtaatggaagtcgtcgttccgtctcccatcgtcagattgatcttaccgtccccaccggtatagccaagctccgccagcgtcgtgcctgtggacacgctgctatccagctggccgccggtcagatatcccgcctgcgccacactgataacattcagggtctgtgtaccgctcggcgcagtattgcttgctgtcactgtagctttggtggtatcggacaccgtggtggatttcagattgtatgcgctggataatctgagattacccacgctggaatacaagctgtaaatcttggtattgagcgtcttccaggcatcctgcttccaggaaagcttggtctgcgcttttttgtacttgttggtcttatagttatacgacgataccagagccgagatgatcgcctctgtgtccagtcctgaatttaatccagtaatacgaattggcatatgctcaccgttcctttctataacttctcatccacaaggattcccgcaatctcccataccttggcgatcatgtccagtgtctcctccggcggatactccttgatgacttcctttgtggtcttgtcgatgatcttgattgtaacacggttcgtcttgtcgtgaattccgaagatcgcctccgagttcttcatctgtttgttcagatcattgaccgctttttttaactgtgttccctgctttgcatctttttcctgggacggatccttatcctcctgatccttctctgtaaaaaagttctgcaccgcgggcttcttatctgctgtctgcgacagccctgcctgtgtggatgcttccggctgtaccgcagtatccggcgtttttgtggatgtcgctgccgcacttccctgatacgacgctgccgctccgctcttcatactctctatttccatctcttaccacctccgtgtgatacatggctcctctatgttcccggttttctatgtcttatatcggagaaactatggcttttattaaccgcatcagaaaagattcttcaacgcctccattgcatctgttgcgttcaatgccgccttgttctcattctgaatctggaggtaaacctccttacggtataccggcacttccttcggtgcactgattccgatcttgacctgatctccgcggatctctaacaccgtgatctcaatattattgttgatgaccagtgactccccttttttgcgtgtcaatgccagcatgccttattcctccgctttcttctttccttttactacgtcatagatcttatatttgacaggatagtcatcttccacaatgatctgtgctcccctgcgggtgtctgtgttaatgacaatcggcgccttgaggttcaccgaggtatccttcggatccggcgctgccgtaagtgtgacgagcacgtaagtattgtcctctgtcatcccgccgagcggacgaagcatctcatcgttcaccatcggattgtaatccgggcgcacgaggtttggctgcatgaccggaaacgccgtgtgcggatcgtccatggactggaaccacatcacggaactcttgtctttttccttttcctcatcaaatatcaatgcaaaattccggtattccggaagtccgatcattccatcctccaatgtaatgatcttatcatccgcaatatcgatttccccaaaaagtcttgtgtttgctttcatcggttctcctccagcttccccgtttggtgtctgttaaatataattcaataatgttgtctgattgatcttcgccgcagcctgtaaggatgcctgatatgcagtgtacgccgacgcatagtcaataatgatctcggacagatcccggtcttcgttggtggactttaattcctccatcgtggtctgctgatttgccatacggttcttggtcagatccaggctctgccccttgcttccgaggtccgtgttcgccagattaaccttctgcagataatcgtcaaaattaccgatgtagctgttataaagcttctgcagattatcgtccgcgtaatcgcgttctttcttcgccgctgcgatccagtcctcaagtgccgcctgacagtcatcggaagaatactcctgcattttctgcattttctccagttcctcgactttattgtttgcgtcctgtgcgaactttaccgcctcgatcatggcgtcaacgtctcttccaatcgatgcatcaaatacagcggatgcctgtgtattgaccgtcagggtctggtttgccgctacgacatagttgatatcctgatagatttccttgccgttttcaaactttatatattccaccggatttgccgcatctgtgatgttggtgcagttgtaataatactccgggcgtacctcgcctttgttaaatccggtcttggtgtagttgacatccaggcttgccttgccgctcttgatcgttgatgacgcatcagagcttaagatcagctcaccgctctccttaataaataccgcttcaccgtctgtgatattgtaggtgttgtccgcagtctgggatgcttttgcccagtcctcaaacgtatcgtatacggttaccttcagttcgccgtccgtctgtgtcacaccggctgcatctgtgtaggaatagctgagcgttccggtcgcaccgtttgccgacagcgcattgccgtccttgtccgtgatgctgtcgatctcgccgtagcttaaacggatacggtcgaatgtcgcctgcttcggattcgagatggtgttgcctgtcacctccgccgctgtggtcgggagtgtcacctcatcgctgtagtagcggtgctcttccaggttcttataggaaagtccctgtgtgatattgtaagatgtcgtattgtcgtctgtcataaaggtcagcttctgattcgtgcggtaaccggtaaaaacggtacgtcccgcataatctgcatttccctccgcgtagacctgatcccgcagcttctctaactgggtcaagatcgtcttgcggtcatctgcggtaatctgatcggatgctccgtaagtacactgtgtacggatgtccgtcagaatcgtcttcatattggcaagtgccgtctctgtcactttcatccaggattctgcatccggaatattgttctcgtaatactggtcaatctcgctgagtgttgtgcggagtctgagtgaacgcaccgcaatgaccggattctcggaaggtctctgaatctttttctgggatgtcatctgattgttcagattgttgacattcactttatttccattgatattgcccgtcgtattgtgaagtataatgttattcgtaatacgcatttatgattcctcctcatgtccttgtctatacaccggtctcaaggatcagtctgtcataaatctctgccatgacagataccatctttgaagaaagattgtaggcattctggaatttgatcagatccattgcctcctcatcttcatcaacgcccgaaatcgacatacgctgcgtgtcaatcgcgctcgccacattctggtaattcttgctgaaaatttctgactgctgggtgtccacggaaatatctgcaatcatgcattttaagaatccgtccgccgtacctccgcggtaaagcaccttgccgctctttaacgtcgcaagttcctccacgagatcgtacgcatccacgccaccctttccgttgatgtcaacggttgtcgccagcttggtcggatccttgacaatcatactgttcacacagatatttgctgctgtcagcttgtaatacgtgtctgagccagatccgttgactgcattcccgttcgcatctttgccgtcgaaggaaaactcttcgccggtcacggtgtctgtaccggtgaaaaatgcatatccgctggtggaattgccgtccagatcgacaccttttttcaaaatattgttgaattccgtcgcaaagctgcgcaggaactggttcatctgactcatataatacggaatacccatcgcgtcaatcgacgttccgaccgatgccgtgcgtccgtctacacgtgcctgctcttccgccgtgagcgctctcttcatattaaaggtataggaagtgatgttgccgtccgcatcctgctcaaaggtaaatccctcatatgcgtactctctaccgttgatcgtcaatatgccttcctccggcatgctgactcccacaatactcgtgatggaaggattggtaatctgaacctcggtgctgtttaacacctttgccagtcctgagaaattctcgccgttatttccgtcgcggatgtcaaacagcgcttttaacgtgccggacatcgagcttccgcccgcattaaaggtattgcctgtcttcgaccatttaatatcataaagtccggctgcatccgtctggttgaccttatactctctcgccttgcactcgagcgtctcgtaattgtaggtatctacaagcacctgaccaccgatttttacagtgtagtaattggcacctgtcggctcgtccggatggttcgtatccgtgatcggcacctcggaaacctcggtcggcacaatctcggacaactcatcaatcaacagggctcgctggtcgcgcagctcgtttgcgtagccgccctgaatctcaatgacgttgatctgcttgttcaataccgctatcttctccgcgatcgcgttaatattctggaccgtggatttgatctcatcattcgtccccttctgaatatcggtcagtccttctgacacgctgttgaagtaggttgccagattctgtgcgcttccgataaactgctggcgggtattgacatccgatgcattgttcttcaatgtatccagtgaattgaacatcgtgttcaggatcgtcgtaaagcccttggatgagctgtcgtcgataaaatagttctcgatctgttgtaagtagctcaattttgtctcatacagtccgaccgatgactgattgtaccagtattttgtatcgtaatactgatttcggatctgcttgacagataaggtcgtaacgccgcttcccacagctccgtactgctggtgcactaaaagcgcatccgatgccacacggttcgactgctgtctggaatagccggttgtctgcacgtttgcaatattgttagccgttgtattcagtgcgacctgataggcacttaagcctgatgatgcaatatttaaaccaaaaaatgtagatggcatgtaacaccctctctttctattacgcgctcaattatccaagctgggtcagcagatgttcgatcatctcattgaccacattgatgaaacggctggctgcattgtaagcattctgatacttgatcatgtaggtcagctcctcatcggaagatacgccgatgacctgctgtctctgattgtccacagaagccaccgttcccgtgaggctggtcgccgtggaattgtagacatttccgtaggttgccatctcaccgatcatatctttgtagtaatccttaaagctgcaagctttggtgtcgttcgggttcagcgtaagccgctcctcatcccacacaccggccagctttgctgccagtgcataatcgacatcaccgttctggcatagatgcggcagcagcgtttcatcgatcacaagcgcctcgttgacacttaagctctgcagtgtgtactgctttgtggtatcgttcgggtcctcttcattgtaaatgtagatctccttggtctccgtcaccgggttgccgttggcgtccactttcggattgccgttctcatctaccggctgataggtgtaagtcgcctttgtgtaccgctctgttccgattctggagaacagttcctgcggcggaagctgcttgtcggaaccggtcgcgcagttgtctgcatccagaattttggtgttcgcatttaatgttacggtcgagccgtccgccagtatcacatccagcgttgtagcagcaccgttcgtaagattcttaatcgtatcttccgcagtcacattcggacaaagcacatcatttaacgcggtcacgatgccgtggatcatctgatccagctgtgcctctgcccgcagcatgacggacattccggtcgtatcgttataggtatcctgatccagtccttcaatatccgtatagttcgcgatatggtcgccgcgcgccagtaccagcgctttcagttcacccatatcgttcttgttctctgtggagatatcccggctgccaaaatcaaatacgttgacgtattttcccttgttcacatccgaaaggtagccccagtacggtgtgataaaaccggtcagcttgtctgttttcttctcgatatgatagcaacggctctcatcgataaactccgtgccctcaatgctgactttcacaataccatcggctgtctcgttgtaggaaatatccacgagggcggacagctcatccagcgcctggtctctcgcatcgcgcagggtcatggctgtctcgatgccgcccgcctctactttcatgatctgaaggttgagatcctggatggtatcgccgagcttgttgacctgatcgatattgtcgctgatctgcgtattgatgttgtactggtaactctgtaatcccgaataaaccgcattcgcgcggctcacgaacagctgtgccttctggacaaccagattctggctcacgctgtcatccggcgtcttgtacaattcctgaaaagaggtccagaaatcttccagtgcatcctggaaagcctgtccctccatctcctgaaaataagtctcgacctcgttggtcgcctcataagttgccgcatagaatgcctgccgtcccgactccgtgcggtaagagcgatccagaaatacgtctctggaatgaatcacatcaccgatgtaaacacccagaccggactgctgcttgctgactgccgtcgtctcattaaaggttacatagttgcggtcggtaaacagtacctgctgacgtacatatcccgtggtatctacgtttgcaaggttatttgccgttgtatttaatgcgttctggctgctctgcaagccggacacgccgataaacaatgttccaaaaccatttgccatggtatcttcctccgtgctgctctatctactgcttcgcgtcaaatccgctgccgccaagcaggtctcctgtattataggcgtttttattgtaattagcggtctccggcgcctgccgcatgctctttagcagcgtaaggtcaaattccaccatctccatcgcctgctttaaaagggcctcgttctgatggttcaatgtctgcatcttcgttcccacttctaaaagtctgtcccggcgctccgcaagcatctgctgctctctgggctggttctccagataaccgatcatacggttgatcgtcatctgctccggctttttcccgagaaccgtcgccatgtcattaagcacctgcgtgcgcttgttcgacaggtttaacagggtgctcgccgcctcctgctccttctccgtcacctcgccaagcttcgcaatgtccgctttgataatcgcctggctcttcacatccgcgagatcaatcagcgtcagatattccgtttcttctttttccagaactcccagaagttcttccattaaactagccacaatctgccctcatttctcttatcctacagcataaaggaacgatatttctccagaagcttctctgcaaaagcctcgttgctcacatcgtaagtgccggatttcacctttgcggagagcgccgccaccttgtcctctctgatgtcagaagtctcggctactgcctgctttgcgatctgataatcatatcctatggaagagatctcaacctgatcccggctcttctcagtctttgctgctgcggatgccccggctgctctgtttgtcttataaatctgtgccacgctgttatacgcttctactcgcataatggcatctcctttctattctgtaacgcaaaaataacttttctagtcaatatatcggatgatttggttttttccttagtgataatttttatgagataaaaagatttcgtcttattttcatcattgacggcaccaaaacaagggcattgatctgccctcagagtcattcttaaggcgcagatgcaatcccctgcaaaataatgtatatgaatccattcatttgaatacaagcacctgcttacccgcagataccattactgtgcaaaaacaatttcactgtgcatcagccaattcgctgtataaaaaccgtttcactgtgtatcagccaattcactgcgcaatggcaatcactgcaatacgagtgtcacggtcagtgttccgccattcgctgatgcctgaatcagcagcggctgtgaaaatgtattcgtaaacttcagatccagatagctgcctgcaatcgtcgcgtcaagtcccgccggaagatagtctaccggaagggaatgtgcatggcgctccgttgccggaagtcccgcatataccatcgccgcatacagtgtggacgatacctggcacacaccgccgccggtgccggtgccctttttgccgctcacatagatcggagccgtcacatatccgttcgcagatgtgcgcggtaagatggtattgctgaaagaaaagctgccgcccggctgtaccaccgtgccgttaatgcgctgtgccgcaagcgccacgtttgttgcgcgcggaatattgtcaacataagaagtcgtacaggtaccgatcaccgtgccggatgcctgctgcgtgctctgtgccggtgcactgctctgcgctgtcccattgttctgtgtcccagtctggctgtccgtctgctgcgcctggctgtctgcctgctgtactgccaccaccggctgtccgtccgcgctgccgtttctgccctcggcttttccatatgccacataatgtctgcagtaagccgccatgtcgctgccgaacgccgcctgcagatcctcataacgctgtctgtatgcctgcggattaaattccgcgctggcattgcggccttccttcacgccaaagctgatgaaatggttcagaagcgcatctgcattatttccataggctgccgccacatccggatacgccgcactgtaataggatgcgtcaaacaccgcacggtacgccgcgcgatccgcctgccctgcctgtgcctgtaccggatgcatcaccataagcatcacgccagacagcacacacaacattcctaataaccattcctttttcacagctctcataactcttcctccgaacgtaaccacagtttcctcacagaccgccttccttctgtctttctcctgtgtgcattctttccgtttcctgcggttctgtctttttttgcattgtaacagagggtttatcaaaaaacaagcaaagttttcagaaagtgtcagaaaaattgcatttgtatctattttccgcttttatcttcatcaagtggttctttttcttcctccatttgtgcaaatccaagcacaaccttaaagagatcgccgtccacatagagcataaagctgccgcccatcagttccatcaggctctttgcaatggagataccgagtccgcttccctcggtattgcgcgattcgtccccgcggacaaaacgctccataagttcctcactggatatgttgagcgggtagcgcgacgtattccggaaaatgagttccacctgcccgccattctcccgcagatccacgtatacccgcgtgcccggctgtgcatatttgcagatattgttcatcaggttgtcaatcacgcgccagaaatgtctgccgtccgccatcacatacaccggcgtctccggcttctggatcagcagcgtcagatctgcggcgttcagtttgtcctcgaattctccgacgatctgcaccacagagacgcccgcctcgagtttttccagatgcacggcgagattgcccgtggaagctttcgacgcctcgatcagatcctcaatcagctttttcagccggtttgactgacgctctaacacttccagatacccctctgccgtctcattggaaagctcctctttttccagaagatccacataattgatgatggaagtaagcggcgtcttaatatcgtgcgagacgttcgtgatgagttccgtcttaaaccgctcactcttcacgctctcggcaaccgcctttgccatacccgtctggatgctgttgaggtgctcgccgtgttcctttaaatcccggtacatgtgcgtcgtatcgaccgggtgctccatatcgccctccgcaaggcgttcgcctccctctgcgagacgcttcatctgtaaaactccccagaagatgcatgcaaactctacgacttttacaaaccgccagcccgctcccatgctgcttcctgtatgaagcgtgccggcaagcgcttccgccatcatggcaatgccaaaaacaagcaccgcccttaggaaaagaggcagattccgggtcaccgcgccgcaaagcctgccgatcacgccaagcgccatgtagacgacggtatttttccaccatgccccggctttcacgcgcgcagcaaaggtcagcagcgacagaagcgcaatccaccctcccgctatgaggcaaaacaaaaccccgacaagcatcggcactgcagcatttctgccgttgacagcttccatcaggatcagaaacagaaatccctccgccaccagcgcaaatccgagatacacatcaagcggcatgccatccagccaggtaagcgtaatcccgtcctctcccgcgtgatgccccgccgaccgcaccagccacaccaggcagaatacggcaagcacaaatgccgccgccagaatcgggaaaatggcatagcggacgccatacatcagcgccgtaagcgtcgtcacctgcacaaacaaatcgtcactccagccaagcggcacattctccggaagaatcgtgactacccagtatttccggtgcagtgattccgccgtgtagttcatctgcagcatgccgtcagtaagctggtacgttgtcctggcatcgcttcccttttgctccagatcagagttcccgattacagtgaccggtattcccacaagctcaccgcaggtgactccgtccagaatcacactgttcgtccagtcgaccgtctgaaatcccgtgttttcgctcagactgtctgcatcgtcgaatgtcacataggtcccgctgtacgcatggagatccagatattttcctacatctgcgtcatacgtgtaatcatagcctgtcgccagatccggcgacagcatcagaatgctcacatgttttaccgggatgtatgcgtccggcgtttcataataaaatatgccgtcatccgcattgtaacaccgcttctcaatctccacctgcgcagcgtaatctccgccatccgtgtagaggctgtacccgccccacagcgtcatgctgtaatcgtagcgtgtcacctcattgatgtcatagcttttgcagtacagcttatcccttgtgaccttctcatcaaaattgcgctccacataagtgtacgattcgttgagatctacggaatcaatattttccgcttcaatgattccatagcggaaatacgtgtcattccaccgattattttccggttttgcaccattttccatgttcacactgtaatccagcgaccggatggcatactgatctgcaacactctgataactctttgtaaggaactgctcgcgcgacatctcatacacgcccgcctgatccataagcaacacgccggcagcccctgtgaaaaataccaccgcaccgagcgtgatgccgacccacgctgccgcttttgctcccacactgtcttttctgtttctcacactgtttcctccattttatagccccgtccccacacgactttcaagtagcgcggctccgccgggttatactccaccttttcccgcaaatgccttatatgtaccgcgaccgtattctccgtgccgtagggattgtcccgccacacctgctcatagatctggttcggcgaaaatacttcccccgggtgttccatcaaaagttttaaaatatcgtattccgtgcgcgtgagcgataccggctccccgtcgagcgtgacctcctttgtgcggtcgcacagttcaatcccgccgatggcaagcacatcccgttcctgcttcatactgccaccaagctgcatatagcgccgcagctgtgattttacccgcgcctgcagttccaccgggttaaaaggtttcgtcacataatcgtctgctcccaccgtcagtcccagaatcttatcggtgtcctcgctcttcgccgtcaaaaggatgaccggcacgttgcttttctcacggatcttcaccatggcagagataccgttcatctccggcatcatgatgtccatgagcacgagatggatttcttccttatttaatatatctacggcttcccttccgttgtatgccgtaaatacctgatagccgtccgccgtcagatagatttccagagccgacacgatgtccttttcatcgtcacacaccagtatgttgtacattttctccccttttccgcgtaaactccccgcaagccgcgccgcacatgccgcctgccgctatttgacgctttttgattctgattttattgtagcggaatgtttatgaagttaaaagaagtgaattcattaagatttgatgaagaaaggaaaaagacagtagggcgtctttcctcctgtcttttttatatctacatttaattataaggttctattctgcatttaagccatttcctgaccgtccactaatagaacagcagatttccccgcttctttgcctgctttagcatcacatcaaagaacacgcttcctatcaccagccacaccagcgccacgatacacaatcccggcagcatgcctgtatattcaccgccaaccgcgatctgacgcaatatttcgttacatctggtcagcggaatgtaatgcgtaatctttaatatggcatcactggtcggcacggtatccgtcacaaaaagaagcgcggtctgtatcagaaatacgatcgttcccgtccgcttaaagtaaattgcgatacctgccacaatcagacctatgccgtacattccgagggattctaatagaatcggcaccagaaacgccggatgaaaagaaaattcaatcccccacacgaactttgaaatgatgacaacaatcacaatcgtaatcgtctcaagcagtaccgaggagacatataatcctccaaacagatactgtaacggatatttcgaggataccttcttgtacaaggttccgtgtgtcagctcgctctgcagcgatcccgcgacattggaaattgccgagatcgcatagatccaggcaacatatcccaaaagcaccagttccttgtaatttccataatgataggtttgtgcgtaagaatttccggaatccgtcaccataaataccgtaaacaaagcgaaatagaccaataagtcggaaatcatcccaaaccggtaacggatcgaccgcagaaaatccatttttatctcataccagaacattctaaacatctgcccgctcctccccatgatacagtttcttataaatctgcccgatttcttcctctcttccattctccacgacttctgcaaagcgcccgtcctttaggaaaataagcgtatctgcgacatccgatgcaaatgagaaatcatgcgcaatgacaatgatacttctgccatcacggacactgcgtatggtatccgcaaccagctttcggttatcaatatccagtccgtccgtcgcctcgtcaataatcacgcattttgcgcctgtcacaaccgcagacatcagcgatacgatgcgcttctgcccgtacgagagcgtttcgaccagtttatttttcaccgtctcatagattgggaatttctcttttccccggtcaatcgcggcatccgccgtactttttcttgacttttcggacatttgattctaatatcttcctgcatgctttgatatatgatagaagaaactcttttttcagggatttttcgtgtgaaatagagaatacaaaagaggtgccaatgtgaaaatcaggagaaaacatccggtcagagtcaatcatctcgggagcgatcccatcccacagctggtgcgccggcttgcccttccggcaatgctcgcccagtttgtcaatgtactctacagcattatcgaccgcatgtatatcggaaatattgcaaacgtcggggacattgcgctcgcgggcgtgggaatctgcggaccgatcgtgacgatgatctccgcgtttgccgcctggatcgggaacggtggagcgccgttactctccatcaaatccggtgaacagaataaggagggcgcttccgccatcctcgccaactgctttgtgcttctgatcggcatggcagtctgcctgaccatcggagcgtatctgtgcaaggacgccctgctagtatggttcggcgcgacggagcgcatttttccctacgcagaaacctacatgcgcatttacctgatcggaaccgtcttcgccgtgctttcgctcgggctgaaccagttcatcatctgtcagggattttccaatctgggcatggtctccgtcatcatcggcgccgttttaaatattctgctcgacccgctctttatcttcgccctgcacatgggtgtgcgcggagcagctgtcgccaccgtgctctcacaggctgtttcctgcgcattttcgctgtacattctgttccgcggtcccgtgccggtgaaaatcacgttccgcggttactccctcccggtatgccgcgatgtcctcacgctgggactgacgccgtttttgatcatcctgttcgacaatgtgttgatcatcgtccagaatgtcatgttgaaaaattacggcggcgccgacagcgacatgctcttaacctgcaacacgattgtgcagagcttcatgctgattatcacgatgccgctcggtggaatctccggcgggacacagtcggtgctcggctacaactacggcgccggcgacaccgcccgcatccgccttgccgagaagcatattttaaagacggcactgcttttctgcaccatcatgttcgtttttgcccagtgggatgtcagtgcaggcattttcgtcggattatttacgcaaaatgccgcttacagatctatgacggtgcattttatccacatctacacgctctccgtcataccgcttgccgtacaatatgcgctcgttgacgggctgaccggcatgagcctcgtgtgtgcctcgctgccgctttccttcttccgcaaagggatctacatcgcgctggcagtctttttgccgattcgctttggcgcaccggcgatgttctatgccgagccgctctccgatgtcgttgctgccgtcgtcacgacgatcgtctttgtgaccgtcgtccccggactcctccgcaaaagagaggcgctcctcggcaaacacatagaaaaataaaaaggaacgcctgtcagaaaatggaactgtcgcaataagcatagcgtactttgctctgataagtaatattataagaaatagatacttaaaagttccagataaacatgcggcggcaaattctgaccgcaaaatccggtatttctaaccatgccgcagctggcatccgtgatgatccgtgtctttccaagtttggaacactccacggactgtgtccgcaagccagcagacaattttaggacttttgtgtgtgtccctagcggcaccagacaacaggtggcataaatgccacctttatgtcgaacaaaacataaccgcgcgaagccgatgtttgaattgccatctgccatatttttaatagcagatggcaacgagtttcggttcgcgcggttttatattgtctgtgaagaggtgccattagggacaccagaaagtccgctcattgtctgcggcttgtcggacacactccgtgagtgtccaaacgtggccaagacacggaatgggatgccagccacggcatggaagaaatacgtgaattttgcttcaaagaatttcccgccgtctgtttattctggaacttttttgttctctggtattctaataatattacttatcaccccaaagaggtctatgcttattgcggcagttccagattccgatagcgttccatttattaaatctacctttgatttgccggttccatattgacagagcgccctttgatcttggtgttcttcattccctcgaggacttctctgccgtactctctcggcacctccacgaaggtatacttgtcgtacatgtcgatcgcgccgaccagcttgcctggcatgccggactccccggcgatcgcaccgagaatgtctcccggcttgacgcggtcttttttaccgatgttgatgaagagacgtaccatcccttcctccgcgccggtattgtcgaagtcgtagtcatcctcgctgccgttgtcgagattgacctggccgagtgcctgcttcaaaaatgccgctgcaatatccattgcggtgtaatccgaagcattcacctggcgctcgatcatgtcgatcatgtccgacaggttctcctcgtcgatgatcctgccgatctcctccatgaccttctctgccttgatctgtgccacatcatccgttgacggaatcggcattgccacgatcttggtcttgcagtagcgcatgatatccttcagcttgtagacttctttgcccttcacgaaggtaaaggcgcgtccggtccgacctgcacgtcccgttctgccgatccggtgcacatagtattcgtcatcctgcggaatgtcgtagttgaaaacggcctccacatcatcgacgtcgattccgcgcgccgccacatcggtcgcaatgaggatctcggtcttgccgctgcggaatcctttcatcacgcggtcacgctgcgactgcttcatatctccgtgcagtccctctgcaaaatagccgcgtccctttaattcttccgcaagttcgtccaccatccgcttggtattgcagaataccagcgagagcttcggattgtagtaatcgagaagccgcgttaagacttctaccttgtcgctacgcttgacatcgtagtaatactgctcaatgctcggaaccgtcagctctttttttaccaccttgatgttgaccgcatcgtgctgatatttcctggtaatatcgagaatcggcttcggcatcgtcgcggagaaaaggatcgtctgacgtccctccgccggaatatactcaagaatcgtctcgatgtcatcgcggaagcccatgttcagcatctcgtccgcctcatcgagtaccaccgtgtggatcgcatcacagcggatcgtcttgcggcgcagatgatccatcacgcgtcccggcgttccgacgataatctgcgcaccgccctttaacgccttgatctggcgtccgatctcctgtccgccatacaccggaagtaccttgaccccgtgcatatacttggcaagtttgcggatctcgtccgccacctgaatggcaagctctctggtcggagagagaatgattacctgcgtctttctgctgttcgggtctaccttgtgaagcaccggaataccaaaggatgccgtcttaccggtacctgtctgtgcctgtccgatcacatccacgcccgacatcacaaccggaatcgcctggctctgaatcggcgttgcctcctcaaatcccatatccgcaatcgctcttaacacctgaggatataaatctaactcatcaaatctaactgtttccatctttttcctttctgtcacgccagagccaattctctgacgcatgcccagcaccggcagaaagtgcccacttctgccgactgcgcagtattttgaatcatagcacggcatctctcttttgtcaagaaatgcgcaaatctccgaacttctgtctatgtaacccaaatccgctcgcggctttgggcaatactcctatgaaaagcaatcgacagatgcgtactttacttgatctgtactttttcatactgctgtgcttcggtaaaagtaaaaggctcgattgcggattttccgttacagtatattctatgccggaatctataaaagtttcctctcttctccgtatctcgcctcttttgcatccagatgaccgagcgaaatattgttgcggctgcgctttttcacctcgtagagcatcatatccgccgcatgcaggaaatcccagctccggcttccctccggagccacgtcaaaacagattccctgcgagattgtgacaaccggaagcgccttcgagcacacatgctcgatccgcctgtcaagaatacgctcccgcagactgtccgccatggaaaaaacctcgtcctccgtcttgtactcgtaaataatgataaactcatccccgccataccgcgcacagaaggtatcgtggctctgcattttccgcagctcatccgcaatcgccacgatgcaggcatctcccgcctgatggccgtagttatcattgtattccttgaagtagtcgatgtcgagaatctctaccgcaaatgctctatggtcatcccgcgtccgctcaaacgcacgctccagataatcattcagccggaaccggttcgccagccgcgtcagcggatccgtctcggacttctccagcagacgctcattcgctttctccatctcccgccgcttctcattcgcatgttctaatgatctgcgcacggagagcatgttggcaatcatataatggttctcccgatccagcgcctcggtcagctcatagaaccggcccgcctcctcgagataagccgcctcgtcctgtttcctgcggtagcagaggatttttaaggaaactattttccgctgcagattcgcaatattggcgtttttcgtcaatttttccaataccgccacgatgtcccagaagacgtcttccttatcgatctccagcaacagtctgcacagcccgtacacgtcatcaaagatatccataaccgccatgtccatatccacaagtccgcggatctgctcaatacattcctcacgaagtgtgattcttcccacgcggtgataatattccgccttaaaaatcagcgccgagagccgctcgatcttctgcatgtgctcccagcagacctgatccagataatccatctgtgcctgcacgcgttcattctgttcccgctgcataaagcaccgccccagacagaccgctacacagctcatcagcccgtaataattcggggtctccggatatgccttgatatcggaggagactttttcaaaatatctctgcgcctcattccactgttcgttgcccagatagagggttccgagattcaagttgatgacgttttcttcgttcgccagcttatattttttacaataaccgagtccggtcagatagtaatccagcgcaatcggcgtatttccacggttcaaaaaggcaatcgcaaggatattataagccctggcaaccatgtcccactgctccgcctgatccagataggtgatagctctggtaatggtcttaagaagctgctcgccctcattgagcacatagtaggtctcgcccgcataatagtaggcaaaccccagaagctttggatcccccgtctgttttgcatattgttcgatatccgcacagtatttcaatgttttctcggcatcggcgccgcggttctgcatcactccgtccacccacgccatcacagctttactgtattccttgaattccatgtaccgattcctcccttatctcttgtttcattataatgaagaaatccaacatattcaagaaccggtgtcttccttttacaaactagctctgaaaaaatgctaccggatcgacaggctgtccgtctttttgcagcgcaaaatacagattgctgccctccaccgaataatatttcgtcggctctgccacgtagcccagcacatggccggattccacataatcacccaccgcaaagttcggctcctttaactgtccgtagatcgcgcggtagccgtcacccagatcgaccgtcatcgtacagccagtctcctcgttgttggagagaccgatgacttttccctttgcgacggaatataccttattgttgacctctcccgcgataatcaccgccggattgtatttgtactggtccagcgtcgcaaagtatatggtagaatccatgctgtaatttaagatcacatttccctccatcggccagagcatgccgtcctccggatcaaaatgaagggcattgacccctgctcccgtctctgcggtctcattctccgcttctttttccacctgcgccacttccgtactctctgtcgtctctgccgctttctgctccagcttttccgtctccgcggtctgctccggcggaataactgcggatgcctgtgctgtctgttccgtactttccgtcgcagcgacaagtccggcttcctccggtgtgttttcctgtgccagttcttcctccagctgttcgcgctgctgttgttcatgatcgctgtaaattaccgtggtcgcaactgctgccgcaatcacaatcgcccccgcaatcacatattgtttacgcccgaggaatgcccaaaatctgctttttctcatttttttcaccatccatattatttatttttattcctattgttccccctgcacggatggtttatgcagagcgtcgcctattttatctgatccgctgtcacaagcgttgttcccggaaaaaaatattgtaaaatctcctcgtaagaggttccttcctgcgccatcgcgcgcgcctcattctggctcagtccgtacccgtgtcccagtccccttgtcacgatccgcacattttcccccatctgcgtgatcgtaaaacacgcggaattccagcccatcgcctcacggaacgcttccccggtgcagacatactcccccagcatgacctgctgtacatagcccgccgcatcccgctctgtaacctggatctcagacaccgcggacacgtctgcctccgcaaaatgctccccgcaccgctttaaaatgtccgtttcctcacaataaatgaccgagagcgtgccctccgccgtcagatccgccgggcactccaccgcgggaagatatggcaccgccgcttccgccgaccggctcatatctctcgtacttcctgcactgatcgcatgatatgcagcatacgcatagccaccgttccaggagagcacctgcccactcgtctcctccacgcacgtctcaagccgttccatggtcttttcatatgtttcccccagcgcctgccttaattcttcctccgaaaaagcagccggctgttcctcccctctcgccgcggcatcatacagtgttgtccgcgcaatcacgcactgcgccttaagcgccgcatcttccgcgtccgcacggatctccttcgccagaatcaggggcagctgttcctccagttcctccccgccctctctttctgccgcctccgtcatcgcgtcgtacgtgccgtatatcacttcctccagtcgcatacgctgacatattatcgtaacaaaaagcggcaataatatgccgatcagcgcgaaagtaagcattctatcaatatagtatttccattttttccgcataaaaaaatctccttgtccattattatatgaaccaaggagatcttccattcccacaaagccgcggcactagttcagactctgcataattccgaatgtcagtgaaaaaactttataaaacgaatagaaaaagtatgccacggtcactccactgtaagcgatggtatagatgatcgggaacgtcatttttctcttaagcacatgtgctctccagatgtaatagcccggtcttaagaaaatcgcaaacaacaccagaccggtgatcttgtatttctgattgctgatttttataatatccagaatcaacagcacaagcatcgccacaaacagcagattggaaaacatggaaagcatctgcaccgggctgccaaggctcacggatccgtcgagataagcgtctattccttcccctgccatcgcattccatgtcgcgccaaataccacaaaattgataataatctgcgccataaagatcaccaggagaatattgcacagaacatcggataccggtccgtgctgctcctgcggatacggattgccctgccagtttccgtaattcggctgctgatacgggttctgaccgtttccgtaattcggctgctgatatgcattctggctgtttccgtaattcggctgttgattcatgttctgtgcatttccgtaatccggctgctgatatgcattctggctgtttccgtaattcggctgttgatacgggttctgaccgcttccgtaattcggctgttgcggcgcgttctgccggttctgatacattttcgtatcctcaccgtatgttctgggcgcctcgctcccgttccatccattctgattgttctgctgtccatccattgtctgtttccccctattctctctatacctgctgcttcattctgcgtccgataatattcgagagcgccgcaaactgttccaatgtaagcgcctctccacggatggtcaccggcacgccaagctcctcaatgctttcctgaatcacttccttggagagatgaatctccggcgaattattcagaccgttcgcaagcgtcttgcgtctctggttaaaagatgcccggatcagccggaacatcagcttttcatcctccacctgcaccggcacggtctcatgacgcgtcagccttatcaccgcgctgccgacattcggccgcggcataaagcagttcggcggcacgtttgcgataatctccggctttgcataatactgcaccgccagcgagagcgcaccgtaatccttcgtccccggtccgacctgcatcctgtctgcgacttccttctgcaccatgatcgtaatgctgtcaatcggcacatggctctcaaacagccccatgataatcggcgtagtaatataatacggaagatttgccaccaccttgatcggtttcccggcattcttctcctccgcgagctttacaatatccagcttcaaaatgtcctcattgataaccgtcacattgtcataagcgctaagcgtgtccgccagaatcgggatcaggttctgatcgatctccaccgccgtcacctctctggcattttcacacagatactgggtcatcgtgccgatgcccggtccgatctccagcacaaagtcatccttcgtaatgcccgccgcctcaataatgcgctcgagcacatgggtatcaatgagaaaattctgtccgaactttttctgaaaattaaaatgatacttctgcagaaccgtaatcgtattctgcgggattcctaatgttgccatgctgccagcacctcatcatacagtctgtccagaaactctgcatagagcgcgcgaaacgtctcgtgaaacgtctgcgccaccgatgcatctccctttccggtaagctttgactcctcatagagcgcaaacgccgtctcataaagctccggattcttatcgtaaaaaacttccgtcagtccgtcctcaaatgtaaactgtgcctcctgcgagagattttccttaaaatcttcccgtgagatcagccccttctcctcgtaatccgagaggtagatgtgaccgtccgcggacttcacaaaatccgtgaacgcctcgcgcacatcctcgtatgtcaccggctgataattctcgttccagtatttgtcaaatgtttcccgatccgggaactgctcaaaaatatctgtatccatctttctccattccaaagcccgtccgagggcttctatctgtacgactccgctctggcaaaagtcacgtcttcgcagtgctcgtccaggaaatcatagatttcccggactgacgggcattcgccctatcatccgtctaaagtctccgatgcccgctccggcaaatgtcacgtcttcgcagtgctcgtccaggaaatcatagatttcccggactaacgggcattcgccctatcatccgcaacagtcgcgagatatagcctgcaagcaggcatatctcgtgactgtcacgtctggcactgctcattgcttacgtacattataccatatacccactgtccaagtgaaccataatctttctcgaacaaatattcgatttcatcttgcttttgtcgaacatatgtgctattctttaaccgaacatttgttttgccaggaggtgttttcacatgaacattcagcagaatctctccctcatggagaagcttgccatccttaccgatgccgcgaagtacgacgtggcatgtacctcaagcggcgccgaccgcaggggagacggcaggcacatggggaattgtctggctcccggcgtgtgccatgcatttgctgcagacggaagatgcatctccctgctcaagatcctgttcaccaacgagtgtatttttaactgtgcctactgccagaacaactgcaactccgacgtcccccgcgcctcctttaccccggatgagatctgcacgctcaccatggaattctaccggcgcaattatatcgagggtctgttcttaagttccggcatcctcatcagtccgaattacaccatggatctgatttaccagacgctctaccggctccgtaccgtccatcacttcaacggctacatccacgtaaaagcgattcccggcgctgacccggcactgattgagaaagcagggtttcttgcggaccgcatgagcatcaatcttgagcttcccacggcaaacggactgaagcagcttgctccctgcaaatcaagacacacgattctctcccccatgcgccagatccagaatggcatcacggagaaccagaatgaactgatggtctaccgcaaagcgccgaagttcgtgcccgccgggcagagcacacagatgattatcggtgctaccccggagaacgactatcagattatgcgtgtgtccgaggcactctatgagaagtttcatctgaagcgcgttttctactctgcattcatcaatgtcaacggcgattcgtcactgccggtgctccccggcggacctccgctgctgcgcgagcaccgcctgtaccaggcagactggctgctgcgctattaccgctttcatgtggatgagcttctgtcggaagaccgcccgaactttaatatttatctggatcccaagtgtgactgggcattgcgtcatctcgacacatttccggtcgagatcaaccgcgccagttatcagactcttctgcgcgtacccggaatcggatacaagtccgcccagcggatcgtcgccgccagacgggataccgcgctcacctatgacgatctgaaaaagatcggcgttgtgctaaagcgcgccctgtatttcatcacctgttccggccggatgatgtaccgcacgaagctcgacgaggactatatctgctctcatctcatggcagaccacacgcaggttccaacggagctccgcaacagcggttatcagcagttgtcgctgtttgacaccgggcttgccctgtgagcccaccgccctgattacacatagaaaagaggtattttacatgtatgtatttatctgtgaggacagtcttgaaggtatctttaccggtgtctatgacgcctgcgcaagccggctcggtcaccgcaatatccggcttgccaccggagaaccggagaattacgagcttttttccgaatatattcacgtaactccttccgcggataagaccggcaaggtgatccgcaccatcacgtcccgtttcggcatgcagttctatgagtcgatctatcaggcagcaatgtccggcgagccatcctccggcaggaagatggacaaggcagacgccatctatgagaccatcctcctcgcactcgcaagcggagacggtcagaaagtgcttctttccttaggcgaaccgtgtgtctaccggatttttgagctctgccgggcgaccaaccgcgaagcctgccatcatctcgaatttctgcgcttctccgagcttgagaacggcgttctctttgccacgatccatccgaaggacaacgtccttccctatctggcagagcatttcaccgaccgtctgccctccgagaactttatgatctatgacgccacacatcagtctgtcgcggtgcacaaagcgctttccagctacattctcacagatgccgcagatctggatctggagaaagtcagccggtattcctccgacgaggaagccttccggcagctctggctgaccttttttgatcacattgccatagaatcccgcaaaaatccgggcttgcagatgcagttaatcccgaagcgctattgggcagacaccccggaatattcccgcttctgctgattcgggcagacacctaccggacgccgaatacacggcaggcattttcccaggtcgtctgctccacctcctgcacagagacgcctttgatctctgcaatcctggcagccacataagagaggttggaggaatcgttgcgggttccccggtgcggctcgggcgccatatacgggcagtccgtctccaacagaatgtgttccagagagatctgctccaccgtctgcctgagtttctttgcatttttaaaggtaaccacaccgcccacaccaatgcagtatcccatcttcacgtactcttttgcctgctccggcgagtacgagtaacagtgaatgacaccgggatgttcccggaatcttccggtctcttttaagatccgcatggtatcctccgccgcgtcacgcgagtggataattaccgggagatccgtctccccggcaagtgcaagctggcgcacgaaccattcccgctgcgctgcctgtacttccggctccttgtcccagtaataatccagaccaatctctcccaccgctaccgtcttcggatgtgccgtctgcgctttgagccaggaatatgtctcctcgttcagcccgtcaatatcgctcggatgcacacccacggcggcatagatgtaatcatacgcctccgccaacgcgagcgtcgtcctcgtcgtctcaatggacgcaccgacgttaatcaccctcccgattcccttttccgggagcccagctaataattgctctctatcctcattaaatacttcatcatcataatgtgcatgtgtctcaaatatcattgttttcctcatcttccctgttgctgcattgccgtctctttcatgtcgctgtctgtcggcacagcttctgtgcgattgctgtaccgccggctcagccgcagttcttataataaaagactgccagctgtgtgcggtctcgtaactttaatttatccagtatggtgctgatataattgcgcaccgtaccctcgctcaaatacaatttttctgcaatctcccggttgcttaagccttctgccaccagttcaataatgccctgctccttctcactgatgtcgtaatcatgataggaaaagctgccttttcctgccagaagcaccggaatttttcccataatctgtccgccgaatacactctgcccgccgtagacagccttgagtgccggaacgatcgactcaaagtcctgtttcagcagataccccttcgctcccatattcagtgcctttacaatgtattcgtcatcggaaaaggttgtcaaaaacaaaatttttgccgcttgatcttcttttaagatacattcagctgcatccaatccggacattccctgcatgcggatatccatcagcagaatatcaggatgctgctcccgataaagccggatggcgtcatctcccgcctctccaagacccacgaccgtaatctccccgtcagcttccagaatcgtttttagggatactgccaccagtttatcatcatcaaccaccagaactctcatttttctctctcccagccttcattaccgtatctacattttatccctcttgggaatcgaaataaagatcacaaatcccttttccgtatgaatccggaaggttccgcccagtgcctgcacgcgctccttcatattagaaagaccaatcccttcctttccgtccatacggacgacctcttcctcccacaatggtccgctctgtccctttcgtcccaccgttccgttgtcctcaacggtcatctgatagaacgccgggtgctcccgcaaaatcacggagatcttatccgcatcggagtgttttgcaatattcgacatggcttcttttaccgctgtgataaagcagtactttacattgcgtggaatctccggagacatatcgtaatcaaccgtgagctgatagtgctccttcatctcacgggtcgcctccgcaatggactgccgcagatcaatggactcatcgtgcagatcgtgcacgctctcacggatactgttcatcgcctgatttaacgtctcccccaccccggcgagctgtccgtgcagcggctcctccttatgaatcgtaatcagtgcccccatctgcagaatacttcttgaaagcatatgccccacattatcatgaatctctcttgcaatgcggttgcgctcccgcagtgtcgcaaggtagatctcataatcctgtttttccatcaggttcttgtttttttcctgcagcaccagattcaattccgtgctggtatcccgaagacggatcatctcctgttccagatacagaattctgcccgttctgcacgccagcaatatcgcagccacgatcagcataccgtccgccgcccacaaaaagggctgccggataatctgttcccgatagaaaaaagcgagccccggaacactcaagaaccagagccgcatctcctttttttccgcacagtcatacagaagaaccggcacgaaaaaacagagttccggcaggataaagcagaccgcaaacatccccgcaaggcacacacaatgccatcgtctgttgtccacacagctgccatatgccgccgcagtcatcgccaacagcaacgctatgaccggcgctgcaagccttcccgactgtcccgccataagcagaccgccggcaagcaacagtcctttatccacaatccgcttcattctaccctctccctgtccacatatgccgccatatttccgggatatcttccactttcccgcacacgttatgataaccatatcatcattacagggctgccgccacatcttttttgaaaaataagagatttatgacatttgtcacatcaaacatctgacgctgctcactggtaccgccgggcgtcacccgctatactgtaattaccatcaaatgaggaggatttgttatgtcagtacctgttgtagaaatagaaaatctggtaaaacgctatcaggagcttgtcgccctcgatcacttcaatctcacaattgaggaaggtgagatcttcggtctgcttggaccaaacggctccggaaagacgacaaccatcaactgcatccttgcactgcttgcctttgacaagggaaccgtccgggtcttcggccgggaaatgcggccggacagctacgatctgaaacgtcagatcggcgttgtcatgcaaaatgtcgctgtctttcaggaattgaccgtctatgaaaacattgattatttctgtggtctgtatatccgcgacaaagcgctccggcgccagtatgtggaagatgccatcgattttgtcggtctcaacgatttccgcaaattttatccgaaaaagctttccggtggtctgctgcgccgtctgaatatcgcgtgcggaattgcccacaagccaaagctcatcattctcgacgagccgactgtggcggttgacccacagagccgcaataaaattctggagggaatccaggagttaaaccgcaatggcgccacgatcatttacacttcccactatatggaggaggtggagcagatctgtacccggatcgccattatggacaaaggcaaaaatcttgccattggaaccacggaagagttaaaacgaatgatcaaaaagagcgagatcatctcgattgatattctggatcttcttcctgcgcagattgcagcgatccgtgacataaagcacgtctatgaggtgacctttgaacatcactgcttaaaagtgctgtgcagcggcggttcccacaatctgccgcacattctgaactatctgcaggaacagaatgtgtctttcggaagagtctattccgaacttccgaccttaaatgacgtctttctggaaattaccggaaaagaacttcgtgattaggaggtaccaccatgttttttcatacgatgaaatatacactgcttaatctgctgcgggataaaggtcaggtattctggtgtgtcgcttttccacttctgctcggaacgatgttccattttgcattcggcggactgggaagtggcgaaagtttttccgccatcccggttgcagttgtgatgcaagaggaatcctccgagctgcgctccatgtttgattccctgtccaaacccggcgaagatcagttccttgaagttacctatgcttccgctgcggatgccagtgaactgctgaaagcaaaagaagtctacggcatcattaccgctgatctgccaaccgtttccgattatagaaatgccgcatccgccaaggatgtttccacgtatcctctatcgctgacactctccgcagagatgacttccgatcctctgtaccagagtattttaagtgtgcttgtggatcgtttcaacatagaatacagtgccatcgcccaggccgcaatgaaagatcccacgaagcttccggcactgcttgatgcggtttctacggaagtcagctatatccggcacgaatcccttggtgccggctccgtggatgaatcccttacttactttttcaatctgattgccatgacctgcctctatgctgccatgatcggcaacacgctcgccatctccaatcaggcaaatctgtcagatctgggtgccagacgcaatgtctcgccggttccccggctgcttgccaccctcggtgatctgaccggagctctgatttttgagttttcctccttgctgatcaccattgcctatctgacactggttcttaaggttgatttcggaaaccatctcggcggtgtggcgctgacctgcctctgcggttgtcttgccgggctgagtctgggatttctggtcggttgtatcgggcagttttccaaagagaccaagtttggtttcctgatggctgcaattatgatctgctgctttttaagcggtctgatgatcggaaacatgcgtgcacttgtggaagatttctgcccgctgctcaaccgcatcaatcctgcagctctcatctccgatgcgctgtattcactcgtcgtgtacccgtcctacacacggttttttacaaatatcgcaggactcctgttactctcggcacttttctgtctcggcggtcttgcactggtaaggaggaaaaaatatgccagtctttaaagcatttttcgcaatcgcaaaaaaacggcgaaatgccgcattgatctatttgggcgtctacgcggtgatcacgctgctgctgtcggcactctcgcaggattccatcaacgagaacttcaaagccagccagcgctctatcgccatcacagatgaagacaacacggatgcaagccgcgctctgtgcgattacctcgcatccatccaccaggtaacaacaccggagcctggagaggacaccgcactgttagatgcaatctactaccgcacgctcaactatgccatggtcatcccggaaggatttgaagaccgggtgctcgccggcgagaccaaagaccttgtctcctccctgacaattccgggaagcagcagcagccagtacgtggacaaccagattacgcagtatgtgcaggcactgcagctctacctggcgggcggtgacaccattgccgaggccatcgaccatacggatcataccatttccgaccttcccaaagtctccgtcacatcttttcagatgtccgacgccgacaccaacagcatggttttttattttttccagtatcttccgtatatctttctggcaatcctgttcgccggcatggctccgattctggttaccttaaacagccgcgacatgaaagcccggacggcgtgctccgctcttcccggaagaacacgtactcttgccatggcatccggctgtctcctgtacagtctcggcatctggctgctctttctgctgcttggtctcgtattctaccagaaagccatgctgcagccgtatgtcggctatgcaatcttaaacagcctcgctttcctgttttttacggctgcactctccctgctcatctcgacgttctcgccggatgacaacgtattaaatatgctggcaaatatcgtcggtctgtccatgtcctttctctgcggtgtctttgtcccgcagtccatgctctccggttccgtacttgccgtaggacgtttccttcccgcttactggtacatccgcgccaacaatatgctggcgggattcggaaaggaagtcttcgacctaggcttttactggaaatgcatcggcatccagttcctctttgccgccgccatgttcgccctgactgctgtcactgcgaaacagcgcaggagcactgccacataggcagacaacgctgtcctttgaagtgctaagtcatattatccaaaacacattctatagatttcaggtagaactgcataggaaagatttattgaaaaaaatgtgtgcagttcttccagccggatgactgcatctgatttcgtgtctcttccacgtttggactctcccggagggtgtccgacaagccacagacaatgagcggactttctagtgtccctaatggcaccgcttcacagacaatattaaaccgcgcgaaccgaaactcgttggcatctgctattgaaaatagggcagatgccaattcagacatcggcttcgcgcggttatgttctgctcattggtgccaataagggacacacaaaagtcctaaaattgtcttctggcttgcggacacactccgcggagtgctccaaacttggaaagacacgaatcatcgcagatgcagccaccggctggttagaaatgccacattttttgaacaaaatatttcctgtgcattctacctaaaatcgaaaagtgtgattttcttataatatgacttagccttcaaaggacaccgcctgcttcatggggcagtgtccctcgccgttttgttacactgacacatccacagatgcgccggcagcggctggcgctgtgtccgatgcagttcccgctcctgtacctgccggcacggctcccgctgtcgcaactgcaagagttcctccgtcggtaagcgacatctccgcttccacttccgcctctgcctccgcttcgatctgattctgtgccatcatctcaagttccgccatcgacattgcggcatcactgatatccagcgtaaatccgctgtcctcacaataagaactgccgccgccaaagcctttgccagcctcgagctgtgacttgatatatttgaaatccgcttccgcaatcttaccccgctcctgcgagcggtgtctctgctgcttctgcgctatctcgttcttctttttcttctgccgaagcacttcctgcgtattctcaatcgataccttctgcttgagttgacgctctttctgtgccacacggcgcttcacttcatgttccttcttctggctcttaccgctgttttccttctgcgcagactgctgctcgcgctcttcctcgcgcagattgcgcactttcaactgcgcacagcgcaccatccgtctcgcatgcgcaagcgcattcgccacttccttggaatcatactgtccggatgccgccgcacgctgaagcatagacaccttgctctttgcacgggtcagcgccgcggatgcactctgcggcttcttcgcccggagcagctgtccggaaatatctctgtgattataattgagctgttttttcgaggttccccctgaactactgacccccgccatctgctcaaatgtatttgtgctttttcggatggaaagtgtgcctgtcatcgatgcctgattgctcacacttcccggtgcattgatgctgattcccatatccacattcctccctgaatgtatccctgactgaatccgttcatatggtatacatcggctgaaattggatttttcgttaggtttcctgcatgaaacagcggatttctgttataaacgatcacagaagccttccaagcagccagcacatccgggtcacatccagaatgtttgccagcaccagaagcccgagtacagtaaacatcagtttttccggcacaggcattttccccttactgtgtgcaccgcttccgctctgcgcagcatctgcactgcctgtcttccagacgaccctcatgcctcccaagttccacacggcatccgtacacacatagatcagcacgaaatacagatagaggtacggccggtctgccgatgcgtaaatcgtcggtgaaaatcccatgacgacccccgtggcaaatccgcctgccagtaaaaacgccgtccacaggtaatgcttccacgctccatccgccagctgccacagggcgtacaggattccaaaaacggacagtatcaaaaataccagcggcatataggtcaccagctcatgccagtcccagtgtgtcgtctgttccggtcgcacgaacacctttttcaaggatgggtggctgacacgcaccaccgcctgtccaaacagcagcagcgccggaatccccgccaaaagcgtcttacggtaattgcctgtcttacggtacacaagcggcgcaatcactgctgccacaacgcaatagaccggatcaagctgggcaataaagatccgttccacgttggcaagtcccatgtagagcttctcccagaatgtaaaatcagcgaactccggcattctccccgccatctcctgcgcgctccggattgcatttcccggacaactgaaaatatatatgagggaaataatatctatgccgcataatgcatagagaagcggctgtttcatacacttttccgagatataatgcagtacttccatgccaagcagcagaagcagcagcaccgcagcctgttcctggctgcccgcataagcacacgctaaaagcgctgctgccgcctcccacaccggcacttttctgccgcagcgaagctgctttaacaccatgccgatcaccagaacgccccagagcggccagagataattggtcgtcgtcgcaatccatccggcggatgccatatccgcaaacggatagagcagcaccagtccggttacaaaccagcgtccgcgcccggtcacacccagcagtccgcagagcagcaccgggagggacgtaaagatgacaatatcaaggattttccagagcagcggacagtgcaccagtggaattaacaccgcctcgatcaccatgcgcgatgaccatgtctcatagcgatgtgccaggatctcgccgagtgaactgttaccgtccagaagggttttaaaatagaccatatcatcgccgacattcgtggacaataccacatgccaaaggacggcggcaagcgccgccgccacaaatgcaccgttttcataaaaccatgtccgttttgctccggtgtctccttttaacatatttcagcacctgccggcatcggtttctccggcgtcatcagcgccagattgccttccgcatcctcagcgcataaaagcatcccctctgagagaactcccgcaagcttcgcaggctttaagtttaccagtaccatcacttttttaccgaccatctcttccggcgtgtaatacttgcggatgccggaaacgatctgcttcacctcgctgccgactcttacctgggagcacagaagcttcttcgacttctccacagcctcacaggaaatgatctctcccacctggaactgaagcttcataaaatcatcatatgtgatttcttccttcgcctcgatgtcgatgacgtcttctgctttttcttctgcaggagtctcctcgccaagcgctctctgctctgcctcaaactccttcttctgtgcctcgcggatcgcttctaccttcggcatcacatcctttgcatccagacgtgcgaataagatctccggcgtcccggtcactttcgtgccgttctcatacagaccaaactgattcagttcctcaaaaccgcggagctgtgtatgaagctgtgccacaatcttctctgcggtctccggcaggaagctgtacagcagggatgcccccaccgtaatcgactctgccagattataaagtacctctgccagacggtcggatttcgcctcgtccttcgcaagtacccacggtgccgtctcatcgatatatttgttgcagcggcggaacacgccgaatacctcagaaatggcatctgccacacgcagatctttcatcttctgtgccactctgtctctggctccggtcacaactgtctttaagtcttcgtccacgtcctctgtcacgcccgtgcttcttaccacgccgccaaaatacttgttgctcatggaaaccgtgcggttgacgagatttccgaggatgttggcaagatcggaattaaagcgctccaccaccagttcccaggtaatcacaccgtcattctcaaatggcatctcatgcagtacaaagtaacgggttgcatccacgccgaacagatccaccatatcgtccgcatagatcacatttcccttggatttgctcatcttgtctccgccctgtaagagccacggatgtccgaatacctgcttcggcagcgggagatccagcgccatcaggaaaatcggccagtagatcgtatggaaacggatgatgtccttgccgatcagatgcagatctgccggccagttctttttaaataaatcggaagaattgccgtccacatcataaccgatcttcgtgatatagttggtcagtgcatccagccatacataaaccacatgcttcgggtcaaagtctaccggaattccccaggaaaatgatgttctggaaacacacagatcctgtaatcccggaagcaggaaattgttcatcatctcgttttttctggataccggctgaatgaactccggatgggtgttgatatgctcgatcaggcggtccgcatatttgctcatcttgaagaaatatgcctcctccttcgccggctttacctctctcccgcagtccgggcacttgccgtccaccagctgggactctgtccagaaggactcacacggcgtacagtaaagtccctcgtaagatcccttgtagatgtctccctgatcgtacagctttttaaaaatcttctgcacctgtttctcatggtctgcatcggtcgtgcggacaaagttatcgtaggacgtgttcatcagatcccagatgcgctttacctcgcctgctacgttgtctacatattcttttggcgtaatgcctgctttttctgccttctcctggatcttctggccatgctcgtctgttccggtctggaaataaacgtcgtagccctccagtctcttataacgcgcgatcgcatcagcgagcacgatctcatacgtatttccgatatgcggcttgccggatgtgtaggcaatcgcggtcgtcatgtaaaattttcccttgtcactcattttgtctgctccttcctaataaaacaaaaaaatcccgtcttcggggctgatatagccaccagaagacgggataactcccgtggtaccacttctattcacacagaatctgcactctgtgcctctgcggatatcgcaacgaatatcccccgctgtaacaggcggtcccgtcagaacttatcgctgtccttagtaacgtccagtgttcagtcctgccactccaaagccatcttccatccgcccttcctcatttcctcgcagcaagctgcaaccgcgcagctggaaatctctctgtaaagtatctgctgatgtactctctttttcctcgtgtttgtgtgtatcgacttttctaagattagcaccaaacccgcggaaagtcaagcgttcataagcacaagagcgccagagaaaaagtattttacttttccacatactcttcccgcagcgggtcttctgcagcgatcgatacgtcttccagggtaatttcccgcagcggactttccggcaggccgcagagtgagacaccgatggcagcatggtttccccggatatgggcaaaacgaagctccgaaaattccggagccttctgcgacaccggcactgccgtgctggaaccgtaattcatgcttacctcgatcgcttccttttctatctcatccatctgcatccgttccacattgacccgctttacatagccaccgcgcccacgcatggatttgatgcggatgccgcgctcggtccctctggccacgcagtcgtggatccagatatcacaaatgccgccggacattccgcttccgattgccactgccgcgtgtcctcctataaagcggcaatttttcacctcaatctgttcgcagggacgtcccactcgccatccgtcctcgttcatcccggaattgatggcaatgcagtcatcgccggtctcaaaggtacagtcctcaatgagtaccttcctgcacgagtcaggattgcagccatcggtattcggtcccttggtgttcactgtcaccccacgcaccacaacatcctcacagtacaccggatgaatcgtccactgcggtccgtcctcgatcgtaaaatcttccagcgttacatgcttacaatttatgaactggatgaacgaggggcggagcgcatccttcctggtcgcaaatatccgctcttctaccggaatttcctgactttccgcacggatcaggtgatccgccgcattctgctggagctttttccagtgccaccacgcgcttcctgcaccgtctaacacaccggtgccgcagattgtaacgttctcacagtctgccgcgtagataagcggcgaataattgtaacattccacgccttcccagcgtgtaaataccggcggaaggtaatcctccatgcaggaactgaaatgaatcacgcatccctcttccagatacagtttcacattgcttttcagatgaattgcaccgcttttccactcgccgcgcggcacgattactgtacctcccgacgcaggaaggcgatccaccgcctcctgaatgacattctgatttccttctgtatacacacatctgatttccatgtgactctctcctttttcttatcctgcctgcttcccatgccatctccgggttcttccgccatatggcttcttcccgctatatggcttccacatgacttcttcccgcggttttctacattcccggcagaagcatggcgcataccggcaggatcacaatgctgagcagggtcgtaatgaccacgctgcccgccgcaaattcttcatcatacgaatactgcaccgcaaagacggaggtgatcgccgcgctcgggcatgcttccagcagcagcaccacgcctgcagccatcccggaaaagccgcatgcaaaaaacagcgcgaagcacacggcagggatcagcagcatgcggattcccatcacagataaaatgcgccggtcgcaaagcatctgcgccagattgcttccggcgatcatcattccggtaataatcatggagagcggcgtattcatatttccgatcagcgcgagcggctgttcgatcacctccggcacaggaatctggcacaggtagatcaccagtccgatcaccacggcaatcagcaccggatttgtgcagactgtgcggacgacctctttcggctccacggttcctgtaatcatgccaaatcccaccgtccacagcagaatgttgaacaccgtcacgtacacactcgcatagatcagtccctccgcgccaaacagcgcctcgatcagcgggaaccccatatatgccgcattggaaaatatacaggcaaaccgcaggatcggacgttcctttcctttcatccggcaggtacataacatcgtaatcgcaagtccggccagaatcgcaagcacactgaacgcaaacgtctgcggcagtctggcaagcacggagcggtctgcctttgagatataggaatgaatgaccatcgccggcaccgccaggtagagcagcagattggaaaacgccttttttgcctccggctttatgacaccactctttacacccgcaaacccggccaggatcagacagtacagtatcacaacctgttttgccgtaatgattgccagttccataaccctctgcctcctttcctacgcaaaatattccggaaacgcctgccggatcgtgtcgatgttctcggtgtagcggagcatatgccgtcttgcggtctccgccgcccgctcccggtccctcgccgcaatcgcatccaccagctcctcgtggtcggatacaatgccgttgaccggacggcagcggaagcttaacaccgtcgtgcggtcaaaatgcggcgacaggctctccagaagcgtataccagtaattccggtcgcacatctcatagaaatgccggtgaaattccttgtcatattgcagtatcttgtccgtctgcttccgctccatgtacattttccagatggcaatattctcgcgcagcacatccagatcttcctccgtcagaaggtcacatgccatgactgccagctcggtctccacaatgctgcgcagatgccgcacctcctcgaccagtttcaaatcaatgtgcgacacataggtgcctttcttcggtcttatatgcacgagctgccgctccgcaagcgcaagtaccgcctcccggtacggcgtgcggctcaccccgagctgcccgctcagatcattttccagcagcttctcccccggttccaaatgtacgtttacgatattgtctatgagcacccgcgtcacgtaatcccgcgcggactcacccttcttccgctccatgatggtaagcatcggtctcctcctgtactttctgcctgtatttctgcgcttctttggcatgatgagcaatatttttccggcacaacaaaagcgcggcagtgatatatataacagaatatgttatatatatcactgccgcgttcttccgtcaaataaaaacatgggaaaacatttcacttttcaagctgctccaacgcaattccgatcagcctgccgacgctccataaaatacctaaagggtatgctgtttgcataattgtttattatcatacatataagaatcggccttatccaataatatctgcattgtacactccttatagtcttcggataacgcccatccgcatgcataatcgattgacataggattttcattgccatttaatctatctttttccctgcgtaagtattttaaaatatcctcaacttccgctttactggtatgatatataactgccatgaattcatccccgccataccttccaacaaaatcttcttccggaatcacactgcgtaaaagccgggcaaaattcattattagctggtctcctgacgaatgtcccattgtgtcatttaccgtcttcaaattatttagatcaaacattatgcatgctgtcggttcatcaatgatctctttattattaagtattttctcacatgcacttttattgggtaatcctgtatggctgtctgtatatgccctctgttctaacagcttgttttgcactgccatcttcattgccatcagcgtctgcataataaccaatattaccaggcacaacatatcaagtgctgacaaaatctctatggtacgaatctttcttgcaatcttttctgaataattttccgctgcagatactgtttcatctgccatcttaaaataagtttcactcatatttacaatatctgtattttcatatcctctgcttctcaccgcttcaatttctacttttaatttttcccagtagtcactctgaacctgtaatttatcctgatattctttatcatgaagctttaccagatcataatgtccatcctggtattttaatccgctcagaatatcatccagatactgaactaattcttcattctggtttcctgtaatttctaactttacttcacgctgtgtggctccacgtaccagacctgcataatttattacccgtgcagtcccctgtaacctgttgatctgtaccatcataaagacaataagaactaccaataccaatataagaccgctttgtgtaatgccaattatatttttcttttccttattcaactccatctctccgtttacccctataccttcaataaccttcatttcacctttaactggatttatttttaataatgattatatcctctctctgactgtgtgtcaaaaaaacagggagcagattctgccctgcagaatctgctccctgtatggaactcatattctatcttttatacttccggtcttacaatgacaaaacgataaacaatacgttcaccgcacaacagacaactgtcagtgccgtcaggaacactgcggacggcactgccgctttggaaaccgccgcagtcacgcccgcatccgccgccggctctgctttccgtccagataccgccacagccgccggctccttccacacgctgcgctgccggcagatgccaaacagtgtgaccgccagaagaatcccgtacagcggcgcatacacgcgctctcccgagacgtagatcgtcgccataaagcccagcaccatcccggcaccaaagccgcaccccaccagaagcagcacgctgatgaaagtaaacagatcgtcgccgaacagctggtacagcgcataaatcatcgctgccaccgtcactgccagatacaccataggaatccacgtcgacagatcgctccagctccactccagaatctcccccggcatcacgaacagccccgagagccccggatatgcagttcttaacactgtctgcccgaacagaatgagcagcggaagcgccgagagaaacgtcctgcggtaatcttttgtcttctcccagacaagccatgtccagatcagcaccaccagaaaaaatacaatgtccgcattggcaataaacacgcgctcaatactcaaaagtcccagatacagcttctgtccgaatccaaacgtcgcataaaccggaagatccgcaatactgaccgcattgcgtccggcattgcccggacagagtgcaattacgagcagtgaaaccacatcgatcaccgcaagagtccaaaaaagcactgcatttcccggccttctgtgcgctttccacagatacacgccgctaagcacgagcagcagcgtcataatcacggcatactgttcatgacttcctgtcacaaccgcgacaggaaccgcggacactgccgctgccgggtgaattttctccgcaagcgcaagcttccttatcacccacgccacataaaaaaatccccagaacggccagaaatgtgtaactgttgtcgtaatccatcccgccgtacccatgtcgtgaaacggaaaaatcagcaccgccgctgccgcgcaccagttcatcgtcttcccaccgccgaaaagcccggacagcagaagaggcagcgtcgcaaacagcagaaaatcaataattctccacaaaaccgggcactgtatgacattgaccagtacacactccgacaccacgcgcgacgtccaggtcagatagcgctgcgtcagatacgcccacagcgtcgtgtcttttgtggcatcccggaaaaaaatgtcgtcccccgccatcggcttcatcccgacgtggtagaccagtccgatcaccgccaccagcacaaacggaaggtatgccgcgtatctgctactcttcctcatacatatcatccatcttcgtaccacagttgctgcaatatacagcaccttccggcatcttcgcaccgcacttcggacattctgcagaaccctggatccgcagaacctcggctttcatgcgctcgatctcctccacagcttccttgatcaggaaaaactgctctgcttcttcacattcttcctcatccttgtgcttctcataataagagcgtcccagctcctcatactgcttctgcacatagtcctccttggacttgatatccagctttaactttgcaatctcggatacatccttcgccttctggctgacatccttccccgcacttaccagtgactcgcttaacttatcaaaaaattccatgaagttttcctccctgtcgtttctttttccccagtataacgccaatttccctttacagcaatcgaaaaaacaggaaaaatctttttctgcaatatcttttcatgctaccgcatgcagatatacacaagatagaccgcatagagcgccagcatcacaatgccctcgaagcggtccagcttcttcttcgtccaggcgaacgcccacaccagtacgctcatcacaaccagaatcacaatatcgatcacattttccatgataaatgcgatcggactgatcgttgctgcgataccgagcacaaacagaatattgaaaatattggagccgatcacattaccgagcgccatatccagttcatttttgcgcgctgcaaccactgaggtcacaagttctggcaggctggttccacaggcaacaatcgtaagtccgatcagattctggctgagtcccagctttgcagcaaccgtggatgcgccgtttacaacaaaatccccaccgaacttgatcgccacaataccaccgacgataaacacgatacatttccacaccggcaatacctcatactcatcatctccggcagcagcacgcgctttcagtgccgagcgcaccatccagaccagaaaagcgacaaatacaataagaaggatgattccgtctgccctgccaagctgcattcccagatatccgcagactaaaagcaagactgcacagactacagaaaacggaaactctttttttaacgtactcttttcaacatagagtggattaaaaagggcacagaatccacagaccaccatcagattaaaaatattagagccaatagcattgctgactgcaagtgcattattgttcgttaccgatgccgtaatactgaccgcacattccggaagactcgtccccatcgccacgatcgtaagtcctataatgattgagggcactttcagcatctttgccacggaagagcttccctccacaaaaaaatctgctcccttaatcagaagcacaaatccaacaacaagcagcacaactgcccaaagcatttctgtcataataatctccattcctctctgttttctctactgtaattattttctcaaaattatctcaacttccggtagtccagcacctatcccacaaacccgagatgctccagcagaatcttcacgccgatcagcaccaggataatgccgcctgcaagttctgcctttttcttgtagcggtttccgaagaaattgccgacatagacgccgccgatggagatacaaaacgtggtgagaccgatgatcgtaaccgcctccccgatcggataattcaaaaatgcgaatgtaattccgaccgcaagtgcatcgatgctggtcgccaccgccagcacaaacatctcttttacgtcgagcggcggatccatcttgtcgatctccacattctcatcctccggccgcaccgcctcggcgatcatcttgccgccgatgaataccagcagcacaaaggcaatccagtgatcaatactggtaatgtagctctcaaactgtgtgccgagcgcccagccgataaacggcatcagcgcctgaaatcctccaaaaaacagaccaatcacaaacgcctgcttcttatttaccctgcgcatcgcaagacctttgcagatcgacactgcaaacgcatccatcgaaagacccactccaatgagcagcaattcaataaaaacagccataccaacctccacattttattctgcccctgccacagggcgcacatacacattcagcccggatgatgcatttcccgccggcgcacacataaaaaagagactgatgtatatcctctgcgcaccgctcccgtctccgtctgcgatataacaccaaagatatacatgagtctcattctttaagatttgccaggtcaggctgtccgaccggtctgttgacaaatcacgctctgcgcgaactactccctcacggaatctgcattcatcaataacgctgttttcttactatatagcagcccgcattttttgtcaaccaatttgtcaaaaaaacaacctttttatcccagaagttcgagaatttcctccttggtaaaggaaacggaatccattccctccccctcgagcacctgttttgccagttcttttttgcgctcctggatcgcaatgatcttctcctcgatcgttccctcggataccagcttgtagaccgtcacgacatgcttctgcccgatgcggtgggcgcggtccgttgcctggttctgcaccgccacgttccaccacggatcatagtggatcacaatatccgcggccgtcaggttcagcccggttcctcctgcctttaaggaaatacagaataccggcacgtcgtcctcgttaaagctctccaccatctgcatgcgcttttccttgccgacagaaccggtcagcatatagtagtcaatcccggccttcttaagccctgccgccagacgatccagcatggacgtaaactgcgagaacaataacaccttgtgcccggcaccaaccgcgttctcgatcagttccatgcacatctgcgcctttgcggactcccccttatagccctcaaacagaagccccgggtcacagcagatctggcgcagtctcgtcagctccgcaagaatctggatcttctcggagcggaattccttctcggatttgccctccaggctctccttcatgcgctgcacatgggcgtcatagagcgcaagctgctctccttcgagcttcgcgaagacattctcctccagcttcgccggaagatcccgcagcacttcccccttcagacggcgcagaataaacggccggatcatgcgctgtaagcgctgcatacggttttcatccccgtttaccacgatcgggatctcgatctcctctcggaaccgctgataagtatataaaaatcccggcatcagataatcaaaaatgctccacagttcgctcagccggttctcgatcggcgttccggtcagcgccagcttgaaacccgcagtaatctgcttgacgccttttgccgcctgggttccagggttcttgatatactgcgcctcgtcgatcacctgaatcgcaaacaccatatcgcggtacagctccacgtcgcgttttaacaggtcgtaggacgtaatcagcacttccccttccttcgtgtgtctgacaatcctctggcgctctgtggcgagtccggtcacgagcgtcgtcttgatctgcggtgcaaaacggctgatctctttctgccagttgtagacgagcgacgccggacatacgatgagggaacggtgccactcccgctctcctgccttggcactctcctgttccgacaagagcagactgatgacctgcagggtcttgcccagtcccatatcgtccgcaaggattccgccgaatccgttctcgcgcagtgtctttaaccacagaaaaccgctcttctggtagccgcgcatgatactgcggagcgaatccggcacctcataatcgctgtcctcgatcgtcttcatattgcggaccatgcccttgaactcgcggtttttctccacggaaagctcctgattgctctttaacgccgcgtccagatacatcgcgcggtattttggtacgttcacatgaccttttttcagtccggattctgtcaggcggagatcctcgctgatctccgcaagcagtcccagaccatcctcgcgcacatcaagaaaatctccgtttttcagacggacgtatttctttttccggtcgtaccgggtcagaagatatgccagctcctcgcgcgacatctcatccgagtggatctgcaattccagaagatcgctctttagcgcaacgcccaccgaaaccgacggcgatgagacgaccttcattccccggaaatcctccgtcgtgtagatcgacatatactcgctgaggcgctgcagaccgctgcttatgagctgatagagcatgtcctcgttgtgcgagagaatgaagatcgtctgcccgagtccgtattcgttgaagtacggctcgaccagcgtgcgcacgcgcatctcctccccaagatcccgcacctcgcccggctcaatcttctgcaatacgttatatttgtcgtccccgtaggcagcgaccagcttcgcaccgaccgtctggttgtcctgcttgtccagatacagttcaaactccggctttttcgggacgtagagcgtctcatcgaagccctccgccgtcacccggaacgtctctcttaaaagcggcagcagatcccggcagaacgacggcagttcatccgccgcaatgtaacattccccgccggcctgacgctccatatagtcgaaaaagtctcccgtcttcgcctttaacgcctcactgctgcgatagatcatgccatcttcataaaaatagtaaaatctgcttccccttatgacctgcagatcctccagcagaacgaaaacaccagacgcccctgcgcggatctcaagcttcggcttgcgctctccctcctgcacatgatactcctcctccggcagatacccgatttcggcagataaaggcatttccccgatggcgtcaaaaaaacggtcgatgccgacctcatcgagctccatcgtgcgctcatatcccccagtgtaagcataataggcatgaaatctgctctggcgtttcttgtcgtcatcctgcatccgcatgaactctaccatccgccatgcatcttctgtaaatgcctgtctgttgtgataaaagtccagctttttaccgtaatgcaccttttcattccgctcgatggaatgtaaaaaggcagaaatattctttaatacatacttctgctccattccgatcttaaattccaccgtcgcataactgtaatccagcttaaaataaggctccagttccacctttccatagacgctctctggaatcagatagctcacaccggcacgcagtgaatactggttcaaaagcgtcttgaacgctcctgccgtctgcatcggggcgacaggcttctcctccgcggcgcttccctgctctcccgcctcatgtccggtgcgcttcgcagccagaatgtccttcgcctgccttcggttaacataagcaagaagcgctgcgacacagtgtttgcacattccctcataattataaaacgcttcgcaggtacagttgctgcttgacaccgtgccgtactcctcatcgacaaccgccgtcacccggtagctgctctgttccttcccacgtacctccgctcgcacctcggcaacgggcagatcatgctccagataaatatcatacgcgaaatccagcacgccccctgtctcatataattcctttcctctccggtagactgccggatacacatcctctttgatatccgatacggaaaacataacctctcctcctgcttttgccctctgttctctgacatataattgtaccataaaatccttttttcttcattcttttcttttaatttttttgtcaaaatatggtacaatggtacatatcttgtgattgaaatacttcttattttttatgggggtctgtcatgatacaatatacaatccatgaagttgccggtttgcttaatatctccaccgacgccatccggctctacgagaaggagggtcttgtctcacccacccgcaatccggagaacggctaccgctgctatgacaccgaacagatccaccgcatcatgggagtctgtctctaccgcaagctcaacgtgagcatcgcggagatcaagcggcttctcgctgtctccacccttggtgatctttccgaaagcttttccggtttcattgattcgcgcaaaaaagagatcgagcggcttaccctggaagtcgaaaaaatgtcttatatgaaacagcacctggataccctggatgaaggcagccgcactataagcatccggacgcttcccgctgtctatccgctctaccatcaggattccgcttttttaggttaccgcacgctaaaggatgtctttcattctccgctgttttcgatggggaatttcagctacatcctctccgtggaaccgtccggttcctgccaggtcagcgccttccagtttgccatccgcgagccgatgcttgcactcacccagctcaattccaccaatctgcccagccgggacagctgccgctgtctctacaccgtagtcgcattcccgaccgagcaggagatactctgggatctctccgccgtcctgaaatacgccggggaacatcagctttcctgcaaactggaagcttacgctttctacgtcttcagcatagcacagccggatgtcatcctggattattacgaagtatatcttccgttggaagactcctgattttttcaacctcctattgaccttagacctgcaccaaggtctatgttagtatcacaaacatctggtactttcgtacaggaaaaggaggtctatcatgaacgattcaagagagttaacgttacaggaacgctccacaaagcgtgccaactattgtctgatgcttacagttctcatcatttccatctatatgatgtttctgtttataggaacaattctgcagggaaatcatgctcttttccgtctttttgtcattgcaggcatgattgccctccctgcagctgttagtacattgttctatttttttaatcctgtttccatacgctaccgcaatgtagcgattacatgctttctgatcatttatgaagtcagctgtctatcctcaaaactttttgtctataatctctttatgattcctgtgctcgtggcactgctcatgtattttgatttaaaactcgagatctgctcaggcgttttaaacatgatctgctgcatactaaatggtctctattccatccatgtgcttggaacgaattcacttgcagaaagaaacctgatctttgtcatctgttccattattattgtcatcaacacaatcacctgcctggcgtcccgcgtggccgtcctgcacaacacagaggagctcgccgaactggaagcccacaagaaaaagcaggaggatatgatgaattccatcgtgaccgtcggcacatccgtcaatgaatccacccagtccattcatgcgctgatcgaggagatgacagaggcaaccggctgcgtcagccaggcaatgggcgacattaccgtaagcatggagagcacagtcgcaagcattcaggaacaggcttccatgaccggacggattcaggacatcattgccgataccgtgtcgatcgcagacgcacttaccaacatctcccagtcttctggtaaaaatgtagagaccggtcaggcgcttgtgagcaatattgtctcccagacggaggaagtagaatccgagaataagctcgtcaagaaaaatatgactgcactgcaggcacatacgcaggacatgttaaaaattatcagcattatccagcagatctccgcacagaccaatcttctcgccttgaacgccacgatagaagcagcgcgcgcaggggaagcaggcagggggttcgctgttgtcgcggaggagatccgcatgctctccgagcagaccaagcagtccactgaaaatattgaggaaatcatcacaaagctgaatcaaaatgccggtgacacaatcgcctcgatggatcatgtcatggacaagatcggcaatcaggtcagcatgattcatgatattgaagaaaatttcagcggcatccgctccggtctgaccggccttgaacagaatgccgccgccatctcagagaagacacgcattttaagagaaaccaacaccatgctggtcgatgagaccaacacgctctcttcgaccagcgaggagatcagtgcctctgcggaggagaccaacgcgatgtgcaccgacaatgccgagcgcttcaagagcgtcaacaatgtcatcgcggagcttgccgccgaagccggcaaaatgaacggttttatcgaagagtaccaccgcctgcacgacgcggacaccgacgccgagacggcaatctcccggcaggcgctccacacggcatagaacggggcgattcagcaattcatgctgacgtccggaagaaatccgcaagcttctgccggctgccgggagtcacgattcgtttgagcaaaatagcgcgatttcttccatgccgactggaacatccgggttcgtgtctcttaccacgctttgacactctatgcgggtgtgtccgcacagcaaagacaatgagtggacttttgggcagcgcttggcacacctctttacagatttaataaaaggaactgtcacaataagcatatcgcactttgctttgataagtaatattacgagaaatagatacttaaaagttccagataaacatgcggcggcaaagtctgaccgcaaaatccggtatttctaaccatgccgcagctggcatccgtgatgatccgtgtctttccaagtttggagcactctacggactgtgtccgcaagccggcagacaattttaggacttttgtgtgtgtccctttatggcacctctgaacaaaacataaccgcgcgaagccgctgtctgagtcggcatctgccctattttcaatagcagatgccggcgagttcggttcgcgcggttttatattgtctgtgaagaggtgccattagggacaccaaaaagtccgctcattgtctgcggcttgtcggacacactccgtgagtgtccaaacgtggccaagacacggaattggatgccagccacggcatggaagaaatacacgaattttgcttcaaagaatttgccgccgtctgtttattctggaactttttgttctctggtattcctgtaatattacttatcacttcaaagagatctttgcttattgcgacaatttcttatattttgctcaccggtgtgccaagcactgcacaaaaattttaaaattgtcttttgctgtgcgaacactccccatagcgtgttcaaagcttggaaagacacggacgatcgcagatgtgagaacagcatggttagaaaccgccggttttgcgatcgaatcgcgactcccggcaaccggcagaatccggcggatttctccggccgccgtcataatataccaaagcgccccggtttctgccgcgtcgcgcgggctagaagattaccgtcacctcggtgcccacgccctcctcgctggagagttcgatctgggcttcgtgctgcacgacgatgtgctttacgatcgcaagcccgagtcccgtaccgcccgtcgacttggaacggctcttgtcaacacggtagaaccgctcaaagacacggtcctgctgctccttcgggatgccgatgccggtgtcgcgcactgtgagcgccggtctctggttcttcatgcccgtaatgacggtcacactgccgcccttcttattatagcgcacggcattgctgcacagattgtagagcagttcctcgatgagcgtcttgttgccgttgatcgtcaccggcccgccttcctgcagcaatgtgacctcgttcttctgcgccgcaatctgcatctgatcgatgcaggtcgtcgccagcgcatagagatcgatcggctcaaactccagcttgaggtcactgttgtcaagctccgagagcttgatgatatcgttaatcaaagattgcagacgctccgcgctccggtgaatctcatttgcaaaatgctcggtgtcgcgctcgttggtcatgccgcttgcgatcagttccgcgtagccggagatcgccgtgagcggggtcttgagttcatgcgatacgttcgcggtaaattcctgccgcatctgtgcatggtttaagatatccatatgctgctgcttgatcatcgacacaaacggacgcatctcctcgtatacttcccgctcatcgacgagcacaatgttgtccgccatcttttcgatcggctccacaaagcgctttgtcatgcgttttgcaaaaaaggcgcacaccaggaatacacacaatcccacacccagcgtaagcatcgtcatattccatgccagatggtagatgctgccgctctcttttccgattctaagaacatttccgtctgagaggcgcatcgcataatagaatgtgtgctccgcggaagtcgtcgatttgcgcatcccgcggccttccccgaccgcaagcgcccgctcgacctccggacgccccctgtgattctccatcttcgtctcgtcctccatgctgtcatagagaaccgttccatccgtagcaatcaaagtgatccgcagcccatcctcggaaagctgatcgcacactttctgcgacgcatcctcaaaatccagccgggagatcacatgtgcatttgcctttaagtcatcatagatctgttgtaccagaatgctgtaaaacagcccgatagaacatacggcagtcaccagaatggcgattgccgcaatcaacataaatttggaatttaattttttcttcatagatttttgtctactcgatcatatatcccacattgcggatcgtcttgatgcagcttcccgccgccccaagcttctggcgcaatgtcttgatgtgcatatccacggtccggctctcgccctcgtactcaaagccccatacctgatccatgatcttgtctctggacaggacaatccccgcattgatcataagatatttcaacaattcgtattccttgaacgtcagctcacacggctcatccccgacaaataccgcgtgcttgtcgttgtccatcctgatctcaccatggcagattttcgtctcctccgccacactctgcgtcctgcgcagcagcgctttcactctggaaatcagctccatcacgccaaatggctttgtgatatagtcatccgctccgagatccagtcccttgaccttgtccagctcactggtctttgcagtgaccataatgatcggaatggctgccgtatttttattcgcccggagttttcccagaatctccagaccgtcttcatccggaagcataatgtccagcagcagaagggacggaaccgcccgctccagccgtttaaacatgctttctccgctctcgaattcctccacttcatatccgctgttcttcagcgcatagcgctcaatctcacggatgttgacgtcatcttccacaatataaattgttgccattgttctcctctcttccgcggccgcttatgcacaccagatcgaagatacgaattacagagagtacctgcttccgaactcatccagcagtctggtgaactctgcgctctccgcctcatccagctgctctgtaaagctgtgctcctccagctgtgtatccttcagctgcatcatgtacacggcaatattggaacagtggtctgccacacgctcataattcatggcaagatccgacaggaccagtcccagctccatactgcacttgcccttgcgcagccgcttcatgtgatgcttcttcacatctttatttaattcgtcaattacttcctctaacggctccaccgtatgcgccagcgcctgatcgttgttcacaaacgcatccgtggttcttgtcagaatgtcacggattgccgcaccgtagagattcatctcctcttcacctttcctggaaaacgtcagattttccttgcgcatctgctgtacgctctccaccacattgatcgagtggtcggagatacgctcaaaatccgtaatacagtgcagcagcgacgtcacctgcaggctgtccttataggacagattctcactgctcagcttcgtcagatatgcggtgatcttgtcgtcatagacatcgacccggttctccttgtcaatgacatcctgcgctttctcctccgaatactcgcccagcacgtccatcgcctccagaaatccgtctcttgtcatctctgccatctggcttaccagtgaacggcactgctcgatcgcgaatgccggcgaagaaaggaatctgtcgtccaagattacaaacgcatcgtttgccgtcttcttctcatcctctgtcttcggaatcgtaagatatgccagattctccagtcccttcgtaaacggaagcagaaccagagtagtaaatacattaaaaatactgtgaaccagcgcaatatccgctgcatttacgacgtcgttcgtaaacggaaagctgaaaatggcattccccagataaaacaggcacaggaaaagaaccgtaccgatcatgttgaaatataaatgtacaaacgcggtacgctttgcacccttgttcgcaccgattgcggagatcattgccgtcacacaggtaccgatgttctgtcccagaataatcgggatcgctgtgccaaatgtaaatccaccggttaccgaaagcgcctgtaaaataccgacagaagcggaagaactctggatgaccgccgtaagcagcgctcctgcaagcactccaagcaccggattcttgaacatggtaagcaggttcgtgaactccggcacgtccgcaagcggctccaccgcaccactcatcgccgacataccgtacatcagcacgacgaatccaagcagaatctctccggtaatcttcttcttatcgctcttgccagacatcagcagaataataccgatcatagccagaatcggtgagaacgatgtcggctttaacatatttataaaaaggttgtctccctgaattcccgtcaagctgagcagccatgcggtaatcgtcgtaccgatattggcacccatgatgattccgatcgcttgtgaaagcttcataataccggaatttacaaacccgacgaccataaccgttgtcgcggaagatgactgtatgaccgctgtgacgcctgcaccgagcagtaccgcttttaacggattcgatgtcagattctccagaatgcgctccaaccttccgcctgacatcttctccagtcctgcacccatcacgtgcattccgtataagaataatgccagcccgccaatcagggacaatactccaaaaatatccattctaatctcctttgcatctcattgctttacatcttttttacatacgcatacataatcatttataacgtattttttgacgttttgcaattacaatccaaggagtcggtaaaattttttaatttcaggtaattttccggtaagctttatgtaaaatctgtgtaaaatcacggtttttagaccaattttctacttctcgtgctctcccgtgatcgaatagatgacccactcggcaatgtttgtcgcgtgatcgccgatacgctcaaaatattttgccaccatcagcatatccgtcgcctgctcgccgtttttgacgttctcattaatctttttgatcagctgctgcttaaagtccgcgaacagatcatcgaccacatcatcctgcgcaatcaccgtgcgcgccagctccagatccttgttgacgaatgcgtccacgcacttgatgaccatatcagtagtctctttcgccatactttccaccagatcaatgttgatcgcgctgcgctcgtatgtcgcatcggacatcagaatcgtcatctcggaaatatccgccgcatggtctccgatccgctccatatcggtaatcatctttaatgccgcggagatcagacgcagatcctttgcgaccggctgctgctgcaacagcagcttcatgcagagcgactccacggtcttttcctgctcgtcgatctcctcgtcgtaggcgatcgccttcttcgccttctccacatcctggcgcaccagcgcggagatccccatctcaatcgcgtgctcaatcatgcttcccatctggatcagttcattgttcagttctaacagctgtctctcaaatctgtttctcattgcttgctcctttcatcaaccgaaacgtccggtaatgtaatcctctgtccgcttatcctgcggcacggagaacaatttttccgtatctccgctctcaatgacctcgccgagcaggaagaatacggtcttatcggacacacgcactgcctgctgcatgttgtgcgtcaccataatgatcgtgtattttttcttcagttccaccgcgagatcctcgatcttcgaggttgagatcgggtcaagtgcagacgtcggctcatccatcagaatcacttccggatcgaccgccagcgcacgtgcgatgcacagacgctgctgctgtccgccggacattccgagcgcactctttttcaaccggtctttcacctcatcccagatcgccgcatcgcgcagggatttttccacgatctcatccagttttgccttggagcggatgccgtgcgtgcgcggtccgtatgcgatgttgtcataaatgctcatcgggaacggattcggcttctggaataccatgccgacacgcttgcgcagcaggttcacgtccatgccgctgtagatgtcttccccgtcgagcagcacctgtcctgtgatcttacatccctgtaccaggtcgttcatgcggtttaagcattttaaaaaggtggattttccacagccggacggaccgataaatgcggtaatttctttttcgttaatggacagatccacgtccttgagcgcgtggaaatcgccgtaatacagattcagattcgatatattaaacttttctcccatgttttcctcatttccgcgcttcgcgctattctttcactgcctcaaaccgcttcgcgatcaaggatgagactccatttatcagaaggacaatgacaagcagcaccactgcagtcgcatttgcttcatttttatgtaaaccttcattagaaagcacatacatatggatggcgagcgtacgcccggaatccataagtcccgccacaccggtcacggtacccgccgtgtagatgagcgctgcggtctctccgacgatacgtccaatcgagagaataataccggatagaattcccgggattgctgccggaagcacaatcttaaaaattgtccgcagttttccggcgcccagtccgaagcttccctctctgtaggaatccggcacacataaaagcgcctcctccgtggttctcataatcgtcggcagcaccatgatggcgagcgtcgccgctccggagagcatggaatagcgccagtgtagtgcaatgttgaaaaacagcataccgaacagaccatagataatggaaggaataccggtcagcgtctccgcagtcagacgaacaacctccacgaatttattgccctttctggcatattcgatcatgtagattgccgcccccacaccaaatggcacggaaaacagcagcgagaccacaaccatctccaccgtgttgatgatggcggggagcatggacacgttgtccgaattataatgtaacgcaaacaggctcggctttaagtacggaatgccgctgatgagaatgtagcccaccaggaaaagcagcgtcaccaccgtgagcgcggctgcaatcagaaccagaagcagcaggatcaaagagccgggatgtctggtataggatttcattttatctttcaatgttactttgttaattggatttatctgctccatcccctactcctttccgcttcgcttgattgccgagaagcacagattgataatcaggataaacgcgaacagcaccacgccggtggcgatcagcgcctcccggtgcagatccgtcgcatagcccatctccatgacaatgttcgtcgtcagtgtgcggacgccctgcagaatactgtttggtactcgcggctggttgcccacaaccatcatgactgccatcgtctctccgagtgcacgtccgacgccgaggatgaccgccgccagaatgccggattttgccgccggtaccacgacggtaaaaacgcttcgctcatgcgttgccccgagcgccagggctccctcgtagtaactctgctccaccgcgcggatcgtcggttcagacgctccgatgatggtcggcaggatcatgattcccagaagaatcgacgcacagagaatactctgtccgttgctgttcttaaaatgttcccggataaacggcacgagcacaaccagtccgaaaaatccgtatacgatagacggaatgcccgcgagcaggttcacgaccggctttaagagcttgtacagtccttccggacagaatcttgccataaatatagatgtcagcacaccgaccggcacaccgatgatcagcgcgcctccggtgacgtagatacttcccagtatcatcgggaagataccgaatttattgtttcccggcttccacttggttccggtcaggaattccacaaatccgattttcttcattgccgggattccgtttgcaaacaggaatatgcagatcagcgccaccgccacgatggagatgaccgcagccagcagaaatacatattccatgatcttctctctttttttcatcagagcctccatttacaggtttttcctaaataacgtgtatgttccacgaaaggaccggaagaacattctgttcccccggtccgtcctgctatgctattttcagctgtccgtcctagtttgctgcatcccaggttgttgtctcgcccgtgaagataccctttacggtgtcggaggagagatcctctaccgggttctcctgatttacgatcactgcgataccgtccatggcgatcttcgttgcggtaagtccttcctctgtctcggaatcctttaactcgcgggaagccataccgatgtcaagtgtgccgtctgctgcgccggtcatacctgtggtagaatcacttgtctgaagctcgatctccacgtttgcattaactgccttgtaagcctcgatcagtttctccattaccggagatacggaagaggaaccgccgactacgactttgccttctgctccgttggactcgaatgctgctgcggaatcatctccgatataaccgttgtcggagattactttctgtccgtcaccgctcatgatgtagttgatgaaatcctgtgcagcctcgctgacctcgccctttgttgcaatattgaacggtcttgcgatcttgtaggtgccgctcttgatgttctctacggtagcctctgctccgtcgatcttcactgcctttaccgtgtcgtttaaggaaccgagagatacataaccgattgcgtaggtatcacctgctaccgatgtgagcataacgtccgtgctgttggtgatgatcgcttcctctgtggtattatccactttctcgccgctctcatctttttcttccacaccgaacagctcgatgaatgctcctcttgtgccggaaccatcctcacgggaatatacggcgattgctgatgtatgatcgaaatctgcattctctgccggtgcagcttcgcttgtggtatctgctgcgtctgcggtggttgctgcatctgtggttgctgctgcatctgtggtggtgtctgctgtatcactgctgccgcatcctgcgaacatgctcgctgccataacacctgtcaataacatacacattactttcttcttcattttgaatcctccattcaattttacggaatttcttctccgttttttcttttacctcgtttcttagaacatggtttactttacgggaggaatgtaaaatgcagaagagcacttatgtaaaacctgtgtaaaaatcctgtcacatcatttcaatctgccggcgcagctctaacatcttattgtccacctttgcgatcacgtccgagtagccgcgcgtctcgcgctccacattggcgatctggccggcatctttcttataacacatctgcgtgtccagctctgcccagtaatccatcgcaaacgagcggatctgaatctccacccggatctccgtgaccgtgtcattgtacgtcaccggaacacccgcaatcacatgaatactctgatagccgctcttcttgggatttttcacataatccttttctttgataatgtgaaaatccttctgcttcttgatgacatccgctatccggtagatgtcgtcacagaaaaagcacacgacccggatgccggcgatgtcattgagtgtctgcaccgcctcctcaaaggagacttcccgccctttctttttgagctttttgatgacgctgtccggcgtcttgatgcggcaggacatattgcgaatgacctggcggtggcattgttccgtcaggtcagcattgatcagtcttaatcgtgcctgtacgagatccatggcggcggcataggatagctgcaccatcggctgtaacagtttctcactcaacaggtcttcattcggcaatttttgttctccgttttgtttttcctttatttctattcgcttctttttctttttagaatcattctttggcaaaacccgctgcgcctcccatcgcaccgctctgtgacgtctcccctgccatgcaccggcgctgcatctggaaacagataaatcccacaacaaacatggcggcgatcgctgccacaccggctcttgacgtatcaaacagctgtgtggtgattcccatcagcatcgttcccataaaggaagctccttttccaaaaatatcgaagatgccgaaatactccgtcgacttttccttcgggatgatcttggcatagtaggaacgggagagcgcctggatggctccctgaaatacaccgacaaacgttgccatcatccagaatttccacgccgcatccagccagagtgcataaactgcaaccacaaagtaagcgccgatgcataccgaaatgagttttgaagatgcaaagcgctgggtcagttttccgaacagaatcgcgcacgggaatgcgacgacctgcgtgagcagcaatgccatcagaaggctggtgtcgctgattccgacgtcttttccgtaggaagtcgccatctcgatgatggtatacacgccatcaatatagaagaaaaacgctgccagaaaccacagcacctttttgtcatcccggatctccgcaaagactttgccgagtctggaaaagatctcgcgcacattggtgccgcccgcttccacatagtatttctgttgatagttccgcagcagcggaagtgtcacaaccacccaccatgccgcgttgataaaaaatgcaatcatcatcgcaaccgtgccggagatgccgatcgcgtccgcgccgaggatcagaccgaggctcgccacaaacggcacgcagcttccgatgtatccccacgcatagccctgggaggacacctcatccatccgctcatccgtcgtgacatccacaagcatggaatcgtagaaaatgagacttccggagaatccgacttttgcaattacgaaaatggcaaggaacagaatccaggtccttggaatcgcaagcgccgcacagccgagcactcccatcatcatgaaaaatgtaaacagcggcttcttgcggttcttattgtcggcgaccgcaccaagcaccggtcctaaaaccgccacgatcagcgtggagatcgagatggcgtagcttagatatgcggtggagtccgatgcgctgatgccgtttgcagacgccatgtttttgtaatagatcggtataatcgtcgacaccagcagtgtgaacgccgaatttccgacatcatacagtacccagaatttttcgagtctgctcattttcgttttcataatcttttacctcttcttccttaataaagcggaatatttcatcataatatttcgcacgcgtccgctcatccgcattaaaaatctcatgtctggaatccggcataaagaaaagctttgtccgctccgtctcctccgcaaaccgcgcgatcgcatcgttatccaccatgtggtcacgacctgctgcaaaaagcagcaccggcaccttgatctttgccagattctcccgccgcatcagcttacggctggcgcgaagccctgcgcggacccaggcataacttccgccgtaggtgcggtaatgttcatctaagagccgcttttgaaacatatagtcataacgctcttttgaaaggcagctgctcccctcaaactgcggcgtctctgaaaagccctgctgtcccgccagtgtggcaaagcattttccttttccggtcagacagcagaactccgccagcagttttgccagaaaccgcggatattttccggtctgcatggcacacatcggcgcggagaggactgccgcctcaaacaactgcggataacgttccagtgcaaggattgcaatggcgcctcccatcgaatgtgcaaacacgatccggtgttcctccccgggacttacgaccgtctccacaaaccgcgcgagatctgcggcatagcagtcataactttgcacatgcaccagttccgggtcatccacctcgcgcccggaatacccgtgtccccggtgttccggcacatagaccgagtatcccgcctgcagaaaacggtatgcgacttcgttatatttttccgcgaattcgcaaaacccgtgggaaatcacaacacatttccccgcatccggcagaaaatagcgccggtaagcgatcgacatgccatcttccatcttaagatagcccttctcgccgtgctctttcagataaggctctaccgtctccgccatccagacggcataagcagtcttctcctctttcgcacagcttctatcctccggcatcatccctgcttcccctgcttctttatcacgcgcaccagctccggtgtcagcgttccgtccagatactcggcagcgatccgcctgcccacgtccggataattcgtaatcatggcgtccacctgcatctcgcacaccatgcgcatgtactgctcctcgttcaccgtccagacgtgtacgcgctttccgtgcttcttacagtcttccatgtaattcggatactgcagattgtagagcgccggatgcatggcgtctgcgcccacgacaagcgcgccatagctgaccggattgacaatgccgtcacagtagagcatgccggtcttcgcctgcggattcagctccttgatgcgctgcaccgtgtagtggttaaacgacgagtaccacacgcgctcctccagtcccatgcgggcggtcaggtcaagcacgcgctcttcgatctccggataaaagaccacgccggtcttcaattccacattgatcgtaagtcccgtcggctttaacagctcatagacttcctcaagcgtcgggatcatcgcccgctcgtacccttccttatgcgtccggttgtaattaaatctggaaattctcgcgtatgtaaaatctttgacccagccgctgccgtcgctggtacggtcaaccgtctcgtcgtggatgacaaccagttctccatcctttgtgagctgtacatccagctccacgccgtccgcgcccatctcaaccgctttccggaatgcctccagtgtattttcaggcgcgtagccgcttgcgccgcggtgcgcccataccaatgtctgtttttccatgtatacaaaaacctccgatatgatagcttcttatttcttctatcatatcggaggtttgtaaaattgttcgggtgcgttgtgtaaaatttagaagggatatgtaaaatatctgtaagatcaccctaactgggaaaaatgccggtcagcattttccccgctttatcattccgcgcagaatctgtgcggctccgccgccgtttccttttttatattcctgcccccgcaggtagagctgcttcactttgacggaagccagttcctccttcgggatgtcgtaaggattgcggtccagcaacaccatgtccgctatttttcccgcttccagacttccgcgctccctctcatcaaaggtcgtgtaatatccgttgtaggtacacatgcgcagcgcctgctgcacggagatggattctgccggattgctgtgattgcatgccttatacatccataaaagcgggtccggatctgtgcagggtccgtccgatcccgcacttaaaatcagtccgtgttcgcagaatgtgcggatcggattcagcctgcccgcacgctctccaaggatctgctccagatagctgtccggctcctgcggccagtcaatgaacaccgtctgcactgccagattgatgtgataccgctcacagaccgcaatctcctccgcagtcggcagacatgcatggatgatcgtatgtctgtgatcttctctgggcagatcgtcaagcgccgccttgatggcacgcaccgcctgcacaaacgccttatcgccgatcgcgtgcatctcgatctgcagaccggcgcggtttgccgccttacagaattccgtcactttttcatccgaatagtagagtacgccgcagtccgacgtgttttcatacggcgagagcagtgccgcatccatggaaccgaagcatccgtcaagcgctgtctcaaaacagcccccgattctcggaagcttccgctttaccgccttattcacatcgagcgtctgcataaacacgcgcatctgcatgccgtttgtgatgccgcgcgcaaaaaaacgctccagatcgacgtccagatctctcgcaaagccgacgccgctgaccgtatggatcatgccgatgccgcgcgcagccagatcgtccagcgccttctgcatgtgcgccaccagctgcaccgtagagagcgaagctgtgatataatccgagacggcgaaaaatgcctcctggttcatctccccggtatcctcatgaaaaccgcgcagatgctgcaccttgccgcgcacttcgtttaacagcaccgtgttgacgacacacgcgtgaccgtcgtactttaccagaaagagcggtttgtcgggacacacctcatccagctgcaccctgcgcaccagatgtccgtctgacacggaatacggcgatgcgccaaacccgatcaccagcttttccttcgttttcttcacatgctcccggagcatctgaagaatctcctcattgctctgcgcattcatgacattgagcccggcatgaaacgtcgcgtaacttgcgaaatggatatgactgtccacaaacggcggaatcaatgccccctccccggtggacacgcgctccgccgccacacagccggccggcagcacgtccccacagtaaaggattttcccctgatcctccaacagataatgtgcaatccggttctctttgtcacaggttaaaatgttaccctcataaagtctcataccgtgctcctttccaatcccttaaattttaaaataagaccggaataatgtaaatgccaagtgctatcaccgtcacaagaatcgtgccggctttccagatccggtactccttgtccatctttgccttttcctgggggacggctcctcgaggataccgatctcctcctcgatggacggaatcttattctcatgctttctggtgaaaagcgcccagtagacaatcgccgccacagtcacaaccgccgccgtcagaagcgctatgcggtctgcaaaaatcagaataatggtgtaggctgcgatcgtgacatagcatccgaccgttcctgccggcgccctgtacggccggttcatatccggatagtgcttctttaagccaaggtaagccagacagccgatcatataacataccgcgagtgagatcagcgataccgacgcgatataattgatcgacccggttgcaatcaggataatattgatgatgccgaccacaagaaccgccatatacggcgtcttatacttcggatgtaccttgcacaaaaacttcggcagggaaccgtcctccgccatcgtgtaaatgtagcgcgccggtgcggcaattcccggattgatggtggagagatcgccgccgaatgcaatgccgatgcagagcagaatgatcggaaagcccaccagtccggccgcccggagtccctccgcatacggtgcgtctgccactgcaaggatgtggtaaaactcgtgcggcaccagtccggcaagaaaccactggaataacgcgttgactgcaaatacaaggaataccgatacttttaacgctctcggaagcgtatactgcggatatttcgtctccgcccccatcgatacacaggtctcaaatccggtataacaccaccataccagcccgaaaatgtacatcatttccttaaacggcggcagggaatccatggcaatcccgccgaaatagtccaggtggatgcgcggtatcatatataagaaccatgccacggcacagccccagaagaagaaaatgaatcccgtctgcgcttttccggacatctcaattccccggaagtttaagatcaggaaaaacaggaccagaacaatcgcaatgatccgcgaatccacgccctcgatattgatgccgagttctccaaacagaattttaaaataattggaaaatgccagtgtctcacccgcaccgatgccgaccacagaaatgatgtaatgccagcctgccaggttcgcccagacccggttgagtccgcgcttcgcataattgtaagtacctccggcacacggaagtgccgccgacatctcgccgtagatcagacagggccagatcgagatgagcagggataaaaatgtaattacaataatccccgatccgacatatccaatctgtgaggaaccacaggtaaacagtcccactcctactaccgttcctatcgtcatactgatcgactctttcagtccgagagcacgcaccagctgacctccttcgtttttctccataacgtatcctcctttgtctgtcttgctgctcctatagaaaaagagcacagacgtcccgcctgtgctccttcgcaaccatgtctttattctgcttttgaaaattctacaccgctttttttcttttccaggatctgtgcgatcagatccgcaatatgtgcggctgcctccaccggcggcacaccgtgcctgctgatattcgatacgaccgtatactccgactcaagcatgtccggtctcgcatggtaggcgatatatgccgacatgctctccgacgtcagaagacccgggcgctctccgatgagcacgcaggtcacctccgcatccaggagcggtccgatcgtccgcgcggtattcactctgcaataccgcacgaaaaacggcgtcccgacggtaattcccttatcctccagacccatttttatggttggaaacagatccggaatgttcgccttgatggacggcgagcacagaccgtcgccaaaataaatctgaacctgcggatggtgaatgcagttttccgcaattttttgtctggcatccggcaaaaactccctgccccagtccgggcggagaagcatttcgtttttattggaacatcttgtccgcacctcaaaaacgccaagttcctttaccacttcctttggcacttcattgaacaccgcgtcgtttgccgccgcatgcgccgccagaaaccggagctgtgcctcggtcgtatagcgtgcgccgcaccgtccgatcccgatccgcgcgggcgtcgcatgcttcatcttccagagttccttttcattgtgcgggtgctccacctgcatatattccataatgtctgtctctgtaatatcgcggaggcaggcggtctctttttcactcataaatcccgttcctcctatttaaagaatatggacgggtctccggcgttcggaccgagatgcccgttttcccagatgccccgtttttcaagccatgctttaaactccggtatcggctcctttttcagcagctgccggatactcgccacatcgtgatagctggtggactgatacatcagcataatatcatccgcctgcggcagtcccatcacatagtgaacgcccgccgttcccagaagtgtcaggatcgtctccgagtcgttctgatcggtcggcatgtggttcgtataacatacgtcgcatcccatcggcagtccgtgcagatgcccacagaagacgtcctcgagcgccgccctcgtgagctgcttggtgtcgtagatatactccggtcccatgaaacctaccaccgtgttcaccagaaacgggtgatagtgccgtgccagaccgtaacatctgcattccatcgtctgctgatcgctgccaaacgccgccgaggatgacagttccgaaccctgcccggtctcaaaatacatgacgttgggaccctttgccggtccctcctcccgaaacagcatctccgcctccgacagcatcccggtattgatgccaaacgccgagagcgccgcctccgatcccgcaatcgactggaaacacagatcggcgcttccctgcccggttctaagcgcttccatctgtgttgtcacatgtgagagcacacaggtctgtgtcggaatctcatatttatcccggatgtccccgagcactttccagatcgcaagtgtgctgtccaccgtatcaattgccggattcagtccgatgacggcgtcaccgatgccgtagctgagtccctctaaggtgctggctgccacgccttccacatcatccaccggatgattgggctgcagtctcgacgcaagcacgttttccgtgccgatcgtggtattgcaggtcgccgtcacccggatcttgcttccggcaagaatcagatccatattgctcataatcttggaaatcccggcaatcacttcgctggtcattccccggcttgcgcgcatcagcgccccgctgtctgtggcgtcacagagaatccactcccgcatctcctggatcgttctgtccttgatcgtgccgtagaccgtttcatcgatatcatcctgaatgatccgcgtcaccgcatcctcctcgtagggcactacaggatgctctgttaaatctgccacggtcagctgcgccagcacctccttggcggcaatccgctctaaggcgctctccgccccgacgcctgccagctcgtctcccgattttttctcgctcgcctttgccagcacatcttttacatccttaaattcataggtctgccccagcatccgtgtctttaatatcataagctgctcctaaccattaaatatcaatgtctttactatcacgggaatgacgttacccgatgcaaccggttcgcccagatcaataaaatctccgctcccgcagctgattccatcgatgcagataacgctgcacttctctttcagtctgtgatgcagcgcctgcccgattgcttttccgatatcctcctcaagcaccaggatcagatgcctgtccatgccgcactccctgacatactggtctgcaatcagttctgctattctttgtacctgtgcgaaagtagggcactttaaccccttcatggcaagcgccacctgccggtctttttcctgatcctcccggtaaagcagaagcgcccggtgcatgttttccggcagtttttcaatctcttcctcacgctccagtggaagcttcaccaccggaatattttttaacggaaacggtttcgtcgtgtactcaatcgtacttccggaaatgttcatgctgtagtttcctgcgccgatcaccgtcgcccgcatggtttcccgcgcatccgtcactgccgcccggcgaaacgcttcgttcttccggatcgcctgcgccaaaaggattccgatgtccccatagcggaacagatcctcctcttccccgaagcatgccgccaccccgccggagaacatcacaatatcggacggcgtgccatccgccagaagatggttggtctgcatgtaggaaagctctgctgcctccggcgccagatgcactgcctccgcaagaagttccgccatcgcagcggtgagtctgcgcagcttttccggttctgccgtcccgccctccgcaagatcaatctcaagcctgccgcacagccattgcagctttggcgccatgtagatcactctgccgtccttcacgcggatcagtctgccgccgatgtcgaggcatgccgtatcaaccatatttccgtcctcaaagacacagatatttgtcgtgccgccgccgatatccagattgactacccgcttccccgtcttttgggacaaatctgcggctcccgcaccttttcctgccaaaacagactccagatccgctcccgctgtcgccacgacaaactctcccgccacgtcggcaatcgcccgtactaccgactcggcatttcttttccgggaagtctcccccgtgatgatgacggctccggttgcaagatctgccggacaaacgcccgccttctcatactccttttttataatctcatgcacgcgctccccatcaatctcctcccgggatgacagcggtgtaaaataaatctcactctcgtaaatgacctccttggacactaccttgatctgtggaattctgccaaatccgcctgtgttctggagaatcatcctgctgaacacaagctgcgtcgtcgacgttccaatatcaattccggcacttaaaatctcttccgtctgcattcttctcctcctccaaaaactgttcttttttgtctgtgtctgccgctcaccatataattgcgcggtggttttttatctgcggcagcccggcttttacatcttagtgcaatctggtatttcctatggaataaataagaaccctgcctgcaggattctccgcctgcggcgggtcgctcttgcgacatctttcgtctccgccgcagtgcgcatccccggggagcttttttatgtaataggaacgaagtttcctaattacaaaaaaaaagagagcagccgctaccgcggtgctcccttgcacatgtcatctgatatctgaatttagaagttattatagcatgacactttttgttcagcaatttccttttttaacaaatattttaccggctgctcatatatttttgtcttttttgtaccttttgtatgacttcttccagcctttttgtacggattcaggcagcgttttttgcctgccttacattgtagaccgttgccgaaccaaccaccagcagggcaccgataacagcggttgcaccgattgtctccccataaaaaacagccaccagaaccggatttaagattggctcgatcgtcgaggtcagagacgctgtgaccggagagactgcatccagtccccgcgacaggaacacataggacagaccgaactgtaccacgccgagcagcagcacgaagaaccagatatgcagtgacatttcgctctcctgcccgtaaaacgggattccgatcgccgcgctcagcgcacaggacaccagaagcgacgattcaaagtccgctccgcggaattttttctgcatcatcacaagcgcataggcaagacctgagagaatcgcgagcagattccccgccatggctccggcatccagcgacgtataaaagaagcagaaaatcccggcaaagactcccgcgcaggcaaacaccgcatcccgccccggctttttgtgaaagatcagccacatcagaagaatgacaaacaccggctccgtgaactgcagcacaatcgcgttggcggctgtcgtgagcttggtcgccgccacaaaggcaaacgccatcaccgtattgcacaccgcgccgaagaacaccgtcttattccacacgaacttctggcggcgcagaagcatgtaacatcccacaaccagcgccgagaagatactgcgcgctccctggatcgtcaccgacgaccacgggatcgatttgattaaaacgcctccggtgctgaaacagactgccgatagcagcacgcagactgttcccctcaggctttccacattcatttttctatcactcatatccatttctcccatccgggtttctgtcgtattctccatccgcgcttctgccgtattctcccatccgtgcatccgccgcttcctatgaaatgaaaacatagaccagcacaagtactgccagaaacagtacgtttgcgatcgtaaaccacaggaggtagtgccctttcgtcttattataattgtgcgcgtagatcttataagagatcaggctcgccatcgacgcgatgagcgttcccagtccgcccagattcacgccgatcgcaagatttttcagatcgtgcgtaaaatccgccagaagcagagctgcaggaacattgctgatgatctggctcgccccgatgccaaccgccagttccctgcccgccacaagactttgcaggacagaccgtaccgcctcgatattccccatattgccgatgaagatgaagaaactgataaacgtaaacagcagacagtaatccacctgcaaaaacaccgcacgatccgtaaaaatgagcacaatgagcaccacggcgagcatcagctcccacggaagcacccgcgctaccgaaaacaggcttaatgcaaagagcgccagataaatcccgtttttcttcctgccggatgcgctggacacctgcaaaagcgaaccggtctccagcgagatccggcattttcccgcactgagcacgaacacgacaagcagcagaagcacacctgacacgagcgtatacggcgccatccatccgataaattcacccagcccggcaccggagatgctgtaaagatacagattctgcggattcccgaccggcgtcagcatgctccccagattcgctgcaagcgtctgcagcacaaacgttgtcacaatcagccgctcctggtggcatttctgcaggatcgtgcacgcaaacggcacaaacgtcagaagtgcgacgtcgtttgtgataaacatactggaaaaaaagcacaaaaaaacaagcaccagcatcagctgcgcggtatttttggtctttgccagaagccggctgccgatcgcatcgaacagtccgttgctctgaaatcctgccacaatcagcatcagcgacagcaaaatgccgagcacgcgccagtcaatgtagcccacgtactgcggacccgggtgcacccagaatgccgatgccacagcgaaggctgtggcgatcgtgagtaccgtttctttttttataaaatctgtgatcttctgcaacatgttgtccatcatcttttctgtttcattgtaaaaattcctttcctattttacttctcttttttgcacttgcataggatttttttctgaaaatgcggcatactaccacaagatagcctgttatcgctgtatgcgcacagccggtgcctgtcattttcccatgcacagctgcccgcgcaggaatggagatttacgtgaaaaatacattatccttacctgtcacaaatgaaaacggctcctatgagatccgcctggagagcatcggcgggctgggcgccaatctctgcggaaaaatgctcggggagctcggcgcactgtcgctttcgctcaattccttaagcttttccagctacggctccgaaaagcgcggttcaccggtcaaggcgtatgtccgctggtgcgccgatgaccgcccgctgcgcgtcaacagccccgtgacccggccgcatctgcttggcatctttcacgggggactgatcggcacctacccggtcttggagggcgtcaccgtagacaccaaaatcgtattaaatacccccttgtccgctgacgaggcggcagataaataccatatttccatcggagaactctattgtctggatgcgctcgtacttgcgatggaaagtcattcccgcatcaacatggtcatgctcggtgctctggtgcgcgccagcggatttatcccgccggaagctgccgaaacgctctgccgcgatacgatcgggaaaaaatatcccgcactcatcgaagccaatctcgcgggtctgcgcctgggatatgaaaatgtcaaaatggctcagggcgaccgcaacctcgcccctctgccggacgccccggcggaccggtatgcttggggctatgccaacgctccgatcggcggcgtcaatccgcggatcggaagcaccgtctccaacgatctgaccgcctcgcgcgaagggtacattcccctttttattcaggaaaaatgtatcaactgcggactgtgtgacacggcatgcccggatatggtcttccagtttgctcccggcacctaccgcggaaaaaactgcatggtcaaccgggggcttgactactatcactgcaagggctgcctgcgctgtgtggaagtctgccccaccggcgcactcgtgccggcactcgaaaaagattacccggaaaaaccgcattttcttccgaatcagcatctgctgcccgacgccatccgctatcagaccgtcggtgcgaattcctggatcacaagcgattcttttaccgacgaaaagcgggtcgacggaggcgtcgtataaatgcaggcagcacccgtgaatcgtaccggcgcacagcgtctgcagaatggagaatgatatggaaaaacaaaaaattatgtatgacagcggcaatgagcttgctgcatttgccgcaaagcagatcaactatcacgtcatggggtattatccgatcacgccctctacacagattgcggaaaatctggatgtcatgggcgcggaggggcttcacgacattgccctgatcgccgccgagggagaacacagcgccgccggcatctgctacggcgcctcagccgctggaggccgtgtatttaatgccaccagcgccaacgggcttttgtacgccttagaacagtttccggtgcagtccggcacacgcatgccgatggtcatgaatgttgcatgccgcacggtttccggccctttgtgcatcaaaggcgatcacagcgacgtcatgtatctgctcaacaccggctggatcattctttttgccgatgaaccgcagaaagtctatgattttaacctgctcggtctaaagcttgccgaggctgtccgtctcccggtcgcagtcgcgttcgacggcttttttacgagccatcagaagcgcaagtgccttgtatttgagaatgatgacaccgtcacccgctatatcggggaaaagctttcctgtgacaacccgaaggtctccgcatttgccggcaccggcacctgcggcaccgccgcagagcttccctacgccagcgtcttagatctcgcgcatccggtttccatcggttcctatatgaacgagccggatgtcatcaataaccgctaccagctccatctcgccatggaagccgcgagaaacaagctgccggagctgtttacggaatatgctgccctctccggcagggaactttccctctgcggtgcctaccggcacgaggacgccgaggtgctgctctttgtgctcggttcctcctaccacaccgccatggaagccgtcgaccggctgcggcaggacggcgtagcggcaggcgtgatcaccctctacgttctgcgcccgttccccgctaaggaacttcgcgtcctctgccacaatgctttcacgattcttgttgcagaccggcaggacagctacggcgccgggggcggcaacatgtcgcttgaattaaaggccgctctctcttccctgccgcacccgccgcgcattttaagccggatctacggtctcggcggcaaggactttttcgtggaggacgcccttgccctctttaaagaggcactctcgccggacgctccggcgttcgattactacggcgtcactgcgggcacggaagcttcggatgaggagacttcaggcacttccggcagagctgacccggcgatggcggtttctgcgatgcagccgcaatattttaagcctgtcacaaaggaagaatccacaccgggtcttaccacctgcaccttcgatcccacaaccggggaaatgaaagtctccggcggctccgtaaaagatacgaccgccatgccgatgcgcgtcgcaccgggacacggtgcctgcccgggctgcggcattccgatcaatgtgaacctcctgttaaagggcatcgagggaaatgtcgtcctgctgtttcagaccggctgcggcatggtagtgacaaccggctaccccaaaaccgcgttccgcgttccatttctgcacaatctgtttcagaacggcgcggcgaccctaagcggcgttgtggaggcgtttcaccagcgccagaagcgcggggaatatccggacggcgagattacctttgtgatggtgagcggtgacggcggcatggatatcggtatgggatcggcactcggcaccgccctgcgcggtcataagctgatcatttttgagtacgataacggcggctacatgaataccggctaccagctctcctactccacaccgctcggcgcaaagagttctacttcccatgtcggaaagacgcagtacggcaagaacttcttccacaaggacacaccggagctgatggccgcaacccacattccctatgtcgccacggtcgcagaatcgaatccgaccgattttatccggaaagcggcaaaagccgccgcctattccagggagtttggcactgcctatatcaaggcgctgtccgcctgtccgttaaactggaatgataagcccaatctggagcggagcgtcattgctgccgccgtagactgctgttattttccgctctacgaaattgagcgtggtatcacagcgctgaattatgatcctgcttcgagcaataagaaaatccctgtcacagaatggctgggtatgatgggacgcaccaggcatctgctgaaggaggagtaccgctccgtggccgaagagatccaaaaagagatcgaccggcgctacgcccgtcttagagcgcgtgccgagcatccgcttctgtaggcacacagagagaatccggtcggcgggatgctgtgtccggaagctcatagccagaccggtaattaaaaaggacaggaatttcttcctgccgcgctccccatatcattccatgtctcttgccacgctttgacactctgcggacacacccgcggagcgctcaaagcccagatagacacggagcatcacaaatcaaaaggcaaaaggaaattcgaactcttctcctacagaaaatggaaattccccgtatatttccgtaactttaaaacttgcgccattccatccgtcgattttgatcattccttttacacttccgtcttctgatgtaaagctcagttctccatttccatgatccacaaagcttccttccatttccccctgtctgtaaatagagatcaccgcttcatcttttccttcccaattctgtctgatgatcagggaactgtatatatcaccggttccctgattatctacaaaggttccgtactttgcggaaacttccggcataacaaagtcttcctcttttatcttcgccagctctcttgcaagaacatacgccctgttttttgtaatttcctccagataagagtcctgtaaaagcggatacatactaccattttcttctctggaaccaatatttaataaagtcacttcttctttcagatctatccagtttctctgctctgccagaagattctccttcatctgccggtccgctgaactactcaatctgccccaaagattattcagttccgtatcccatatcgtataaagccattgcgcggctacattcatttcgccctgcgtttgtgccgcctcagctaatggggtatacttttgtgtaaccttctccatattcgtcaattcttcctgcagagatgtggaatccgctactacatcgtctacatcttccttaatattctcagaataatcgcgggtaaagtctattttcagtccatcctccaaatgaatctcatcgttttcactgttctcaggtgtagtttgttcttccatgcgggaattttcgatttctgtattctctttaccacatccggtataaattcccatgcttaacactaataccagcagatagattgcttttttcatatattacctctccccatattttcttttcttcatcctgtgtttccattcgctctgcaaactggaagttttgcatacgttattcttctaatatttttgtagggttcgcatccgttacaaatatcatactatcataaagcaccgcaggaggttgaaacattcgataacttggaggaagaagtcgcataatgattgagtagctttctccaagtgttcccatataggtgtattcagaagcctgcctacctagttcagaattttccgggactttagtaaaatccaaccaacaaatatcaaatcccgccagttttgccgcctttgctaaagggtcatgggaataaaacacctgaattgtacgcttttcaggcgaacgggtcggcatattgcaatgggttttataaaaatcggtaccaatgacatagtaaccatttgctgcgtccttggaaagaagtttacccatcgagtcagaactgccccattttgcgacatggctgttgtgacctgtcacaaagattttttcatgcccatttcgctgctcctgctgtaaaatccactgtacattttctgccataaattgatctcttaatgtagcaccatcagcatttgtcagagtttgaagctcggaatgctgcattaaaatatctacaaagtgaattgcattttccgaaccgttcttgctttccaattctttcttcacttgcgtaagggtttcaattcgagtagataaatcgcattcactgctccagttttcaccttccacaagtttctgcaagtttgttgtgtccacttccagttctttacaggattctttcaaaaacctcatgctgtaagaaatcctctgcatatcaaaaccgtaaaagcgaaggtcttcgccttccaatgcactttcattgtactggcgcatataggagataagttctgccatctcttccgttctataaatggaaaatccaatcgctgcggctgcttcctgtgctgtcccctcaccgccgtgtatatatcggtttacctgctcgcagccgccgtagtcaccttcaagggcaaacgccctaacaccattattttttaccatctgcttgaacacttccagcttcaactgctgaaattctgcatttccgtgagtagcttctcccaatgcaattatttttgcactttcaggcacagttatattttccacgggttcagcataagctaaaaactcttctggattcacattttttcctgtgccaaaacctccaaaacgcataaatacaagtgccgctaaagccataacacctaataatccaaaaacgatatatcttatcttaaatcttcttgtcttcttattcttcatatctgatagccctttataatgaatcagttgtcttacatccgttttccacgcttattgtacttcacgtaatagttcttctgccgtagtgttgaacaattttgcaagtgtaagcagattggaagtgcttgggtcagatgctccggtctcccatttagagacagcctgcctgcttacgccgatagattctgcaacaaactcctgcgtcatcttacactcttcacgatgctgcttcaaaacctcaccgagagatttcttgatgctggacttttcttttctgacattgcctgatttgacatatctactcaatgctcttatgaggaaaattcccacagtgataaatgccgctatcaccgccaccccgattagcagtacaataccaaaaacaataactcctaaaaaatcatatttcacttaattacctcctttcgtgacttcatgatagcgaaatttcatggttgctaccaccaactatcacgatatttctttggttgcgaacggttgcggaactaaaataacacttttttatgtaaaaggcatatatgtaaattaataaaacaacaaatccggatttttaaacggttttaccataccatatctgactggctattacaataactgcccagccccgcttactatacgccacctgttgtctaacaaaacataaccgcgcgaagccgatgtctgagtcggcatctaccctgttttcaatagcagatgccggcgagttcggttcgcgcggttttatattgtctgtgaaacggagagccaccaggggctctcttcccatagccgcagagacggcgcgctagttctgcttcctcctgcgctccatacgtgtctctgcaacgtaaagtacaagatatgccaccgccgcatacaaaagcgtgagtaccatcacagcaatattcggtccgatggcagctggatctgaaagagaatgaagtaatgccggaaccatgatgaccataaccaccagaccggcgggcagcactgttttccttaagaaatgaaccacctcatattttgtccggcagccactgaaaagcacgcacgccgcacagatacatactataaggatgatggacgggcaatccacataccacccgatcttcgcctgcgacaaaccaaatgtcagaaagactgccactgcgagcaatgcgattcccaccagcccctgccatctgcctgcatttttattattctgattctcctgcattaaatgtttcatattttcttccgcctttccaagatattcttcggaaggaagcttctcacccgacagaagttcgtttacattgatgtccagcacctcacagagcggcgacagatatgctatgtccggcatcccgttcccggtctcccacttggataccgtcttgtcactgatgccaatctgttctgccagttctttctgcgtcaaacctttttcctttctcaatactgcgataaatgttccgatcctcgtctgatccatatacttcctccattttccgaacaggtcgctgtccaccgttccgagggacctgtcatgcttttgtaaagctgcagctttatagctacaccttagttcaccgacccgtaaagtgcaatcccttcaccgtagaatacgctctataaagcaaagaaagccgcgtagattatctccctgcgcggctttttctcctactccatatattcctgcaccagcgtcttatactgctgcaccttattggcaatcccgccctgattgtagcggtcgacttccgccgtcaccgtaatctgcatcttgcggtcttttccaagcatcttattgccggaaagatcctgtgtgatctccggcataatcagcgtaatctgatattcaatgcttcgcagaatctgattctcatcgatcacataggtcgccgtcatatcctcgtaatgtgcctgcttgtgctgctggacggatagcgccgccgtcttcacggcgttctcgtctgccccgcttttttcataaaaagcataggacttctccacctgtgccacctgattctcccatgcctcctctaaatattcctgcgtaaaagagcaggtaatctccacagccccgtcctctgtgacacgctccaggtcttccacatctgtcccgtcgtaacccagatctgtcaccatttcataatcaggaatgacggtgttctcccgctgctgtggcagtatctgctcccactcaccactccagtcaatgtaatgatacagattcctcccgtcacagaactgctttaaatagagtcttgtcccgtcctcatccgtcgtgtagtgttcgcttatccagtcacctgtcagcatatccgcccaggcatgcatcgtctctcctccggcgcttccgttctgcttccagcgatattcataggaaagctgcagattgtccacttttcccaaattccacatggcaacctgaatctctccgagttctcctcttcccgtactgttctgacgcagtgcgccaaatatcagcacaccggcaaatacaacgactgtcagtatccgcagctttcttttttccatagcactatcctctatgccagcaatcccaatgtttcaaatgcccgataaattccatcgtcgtcgatggacgatgtaaccatgtccgcccgttccttgacttcttctcgcgcgttgcccatcgcaataccgattcctgcgtattccatcatctgaagatcattcggaccgtctcccacggcaatggaatcctctctcgcaatgccggccgccttcagatatcgctccatgccggttgccttattgattccgttgatgccgatctcgcccgcatattctcccataccttccaggctgatcgccaccgtgtcaaagtaaggctccagatctgcatgtaccttcgccaccggaaacggcgcattataatatagaagcttttcatttctcggattcttccaaggctcttctgtcagatgcatatttccggtcagacgcacaaggcgctcctcgctcatccccatctttcggtagatctctaagattccttcactgctgcggcggttcaacaccacaccgtcgtccgcctgatagcaaaacaggaatccgttgccctccagataatcgtaaacgctcttcctgtgctcttcatcaatatatgcgtgataaatttccttcccatcggcgatcacaaacacgcctgccgcgccgacaatcccggaaaacccaagttccagcagctcatcataaatctggaaacggcttcttcccgtacagacgaccatcttgtgaccgttcgccttcgccctgcggaccgcctctttggtagattccggtatctctccccggtcattgaccatcgtgccgtccacatccagaaacaccacttttttatggttatttatcatttctgcgctcatattttcctgtcctcttcacgattgcttttatgtacatgatatgttgttttggggatggaatcaagctattttaaacgttatatggaaaaaaagtatctttattttttcgactcccaccttacctgtccttcatatagccgccggatcggctgctgttcttgcacccgatcgtatatttatcaatgatcgtggcatcatagaaactctgctgtgcttcctgtatcaatttatctgctataattattttttctatatttcagcggtgataccgcatatgccttctggaaacttctgataaaatagcttacattctgatacccgctctgcatggctacatccgtaaccgggatatcggtgtcctgtaacagctgctttgcatgctccaaccgcaggtatgttacatattgtgacagtgtaatatgaaaatgttccttaaaatacctcgatatatatttttccgagagatgaaactgttccccaaattccctcagcgatatctttcctgtaaaattctgctgtatataggaaaccatctctttttctactgtatttctgccacttgtatcattttctattacaaatcctttcttccacatttcaagaataaattgtaaaagaattatttttgtcctgacctgtgtcgttattttcgattcactttcatccttttttgcctcatatatctcaatcagctgttcacacagttcttttgctgtatcctttactcttggacatatcatcaagtgaccgctatttaatggttcaagcaatttttcatctaacatgtcatctgtacgaaaagatatatactttaacggaaataggaaggtataataatccacagtaccggtctgtgatcccataagatgcagattgcccggcgacaccacaaacgcatctcctgtttttccaatatagctctctccggatatacttaccgccagaaaaccgcttcttacatatataatttcaaattcatcatgccaatgtaccggtatctgaaatgagcgccccgcattctctatatgatatgtgctaaatggatcgtcctttgtgccatgtggtttgttttccttcaattcaaagtacatattctctcctacagttctacaagactcttacttttccattttccgcttttccatctaaacaccattccaacagctctcgcacactcatccgctgccatggcaatatatgctcctacagcctgaagtcccatatgtattccaagaaaatacgttccgccaactgcaaacaggtacataaatatcgcacccataataaccgggaaaattgcatctccactggtttttaacgcctgtccatatacaagatttgtcacccttccaaactcaagaaatatatctactatcaacagctttaccacaagatttatcatttgtgtgtcatccgtaaatatatgaatgataaaatgtccggacattgcaaatgccgcagagaagcacgttgctgttataagaccatatatcacagcttttcgtgtccccctgtcacattcttcaaactcctttgccccaattctccagccagtcataatagcattggcctgtgcaagtgcagctcctatacagtacgagaaatttgctatctgcatagtatacgaacgtgctgtaacattcattccgtccgcatccatctgattcataaatcgtactatcagtgtcattgccacattataaagcgctgtttctaatgcagaaggaaaacctatcttaacgatctgcgcaagtatcttccgggacggaattcgctccgggctctgctttgcttttataagtaccgcgcccatgcctgctacaatcagtagatttacaacccttgaaataactgtggcagcggcaactcccattactccccagttaaacacaaacaaaaataccgaattaagtattatattaatgagatttccaacaaccgttcctatcagtgagtgctttgtatatccaaacactctcagataactggaataaataggaatcagtgcatttaaaaaacatgcgcctccaacaattttaagatatgtttccgccggttcaaacaaagccggggcaatacttactattctaagtattccaccagaaaaaacagcaagaataacagacatcaggatgcccatcactgcattaaacatcagtccaagctgtctggcctgatatgcaactccaggtcttcccgctccgatattttgtgacataaccgctaccatacctgatgatattacgccgaacatgatgataaaaacgcctatatatgtatttgctgttccaacagctcccacagcctggtcacttacagatgataacataagtgtatcaaccatgcctgaaagcatataaaataaagtctctacacatattggcacaaatagctgtgtcaatgtttttctttcagctgccatattttctcctcagatgctccttagatgctaatataatctatattatcaataatacgatatatctgcatatatttcttgtataatatcatgcaaaaattgcactatttctactatgcagtctgtgagaaatctacggagcgtctgacaccgccctcaaacctgctgctttaacctcttcatcacagttttttcgtcaccaaatgtaatctgcaataattttcatcttcaaaaatgacaccttcatcctgaaatccattgctgataaaaaagtccaaatccccatttggaaagacgcctttttcatcggatattgcaaggattcttttatattcgcccgctaaatatttttccagtttcataaggggagcacttttataatcataggctgcatccgtcatgtatacacaagtcagaaacgctatatcatcatcgtgtggaatgtcgtatggaatgaccttcgcaggcaggtattccacaccgccaacgagctctcccttcccgtttttatgaataaaaccatagatatccagctcgtactgttttagaaattctattttctttttacaattttcagacgttttgtccccacagcactcacaggcgatgtcgaacttgtctaaggagagcggctctatgatccctttggtaaaatttctggatattgttggtaaaaaaggtttctcctccggatatattccgtttgctgcctgctccagaaaagacttcctgagcggactatagtatctttttttcttatccagaacaatcagtgtgggaaaaaacatcttcatttcccccgccaataaatgattgttggaaatgtcatatagattgatatctattttatcccgatattcatttaacagccggatcatgttgtcattcaacggacattgatatgaaaaatagtaaaaatcaagtaccatacacccctccatcatctctgattatagaaattttcccacgtcatcacatactccttttcactggtagcttcatccaccccttcacaccggatcgcaaagccttcccgctgataaaaatggatcgcccgtgtgttcttttgatacacatttaagcttagctttgcttttctgtttttcacaaaatccagtaaaagttttccgattccctgcgaccgcatatcatcagaaacgaaaataccctcaatatattcatcatttaatccgatgaatccctgtatctgccgggcatcctcatatacgtaaacctctgcctgtcccaacagttcctttaccagttcaaagttatccctccagtattgagccggaataaaacaatgggcgtttaaattaccctctaaccatatctcggcaactctgcctgtgtattcactctgtaatctgctgatcatcataaatccctttccacgctattcccctaaaagccctgcccgctccagataccacgcctgaaaaccgtcgaacgtcaatcgtttgtccagattttcattcggtctggaagcggattcgataatctcccggcagttcttcgttctgcgcagcatgtcataggttaagcggtaacacacttttaaaaggaatctgctaccatcccagatccagcagccagttattcagtcctctttcccgttccttttcgtcggtaatatttttcaaattggtatactcccctttgatattgccgtctacgataaagaggactctgccgcattttgcggcaactttcgcatcatgcgtcaccatgacaatcgttgtcccctcgccgtttaacttcacaagttcatccataacctcattggaggatgtgcggttcaatgcacctgtcggctcatccgcaaacaacagtctggggcggttcatcatacttctgcatatacatgcccgctgaagctgtccgccggacacctcgttcatatcattatctgcaatttcgataattccgagcttacgcatcagctgctcgcctcttgcctgcttctcttccctgctctcctttgatttcctgctttccactgccgggagcacgatgttatccagaatcgtcagattcttcatcatatacatctgttgaaaaatgaatcccatttcatccagacggagctttgccagatctttttctccaagcttcgtcagatcctgcccctcaaagagcacctgtccgctcgttgcccggtccatgcccgaaatggcatacaaaagtgtagattttccggagccggacggtcccatgatcgccaccatctccccctcatttacctcaagatttacattttttaatacgttattctgccttttatcaattacatatgttttgcaaagatcctttgcacaaagtaatgctgccatatgatgttcctccattttatttttactctatatttgcagtatcgctgctcttaattgtccggatctgcaatgccgtgattcccgatgccagaagcgtcataaggaaaatgattcccggatacaacaggaaaatcttccacgtgttgatgacataagaaacctctaccgcccccatcatgccaaaaatcggatttccaatcagatacgttgcaggaatggaacagattcccgccagaaataccgccgcaagcgtgactatgccaaaccggatcacatgccatcttatcactctgctatttgaaaagccaatcgcctttaaaattgcaatctggcttctctcatctgcaagaaatgactgttccatcagaatacacaccagcagcaccacaatgagtgtaattccaagcagaagatactgtacggattcgatcgttgacgccgctcccatacagtcatcacagtattctgcggcattcattaccttatcattatcaaaaagctgttttatcttatccttgcggatctcaacctcttttgcagacggatgatcggtaaagttaatctgataggacatcagacttgcaatataggaaaaatccgtcggtgcatcctcatgaagccgtatcacggctccaagctgattcatactctggaagtatgccactacgatacaatccagcgtttcggttccaaaatcaattgttaccgtatctcccatttttgcccccgtcagttttgaaatcgtcggtgtgatcgcaatctcgttcctgctctgtgggacaataccttccgtgtattcataatctgacgcaccgacatcaattccctgctcgcagacgatagaataatcgtttccatccacacgcaccttatatttgtactgcgcctccacacacatctttgccggcattccattcgcttccagcagattttccgtatccctgagatagttctcgacccgctctaacccgtccggattcatactgctcatcgcttccgccagatcggtataatacagatcactccgggatccgaatgtcgtgatacatgtgtcactccgcattgttgagatgagattgacaaacaccagcacaaacagggtacagataaaaaatgtaatcacaatcgttgcataccgccgcggcgcactaagcacatcattgactgccagaaacatactcgtgcttccatgacttttccccagccggacagacgattttttcttgtaacgctcccctgtctgaccggagcggattgcatcgataggggaagacttcttcaccaggccggtacaccggaatgcaaaaagaagaatcacaacaatgaccagaaccgctccaagcacagaaagtccaaaatgattgtccgctccaagcacaatgttgttgctgactgaccgtagcatcagattggaaaacggaatactgagcaaaaaccccgcaacagctcctgccactgcgagcatcagatattttgccagatacagactgcgaatcttgaagctgctgattccgattgccttcatcacgccgatttcacggaattcctccgaaatcgtaaatgtaatggagaatttcagtaccacaaaggataccagaatcagacagatactaagaactaacatcgtgaatgccacgatcatatccaagacataacacatttttatcatggaacgcgttccggaaaacataatctccggaaccccggctatcagggatgcaatatcagacaatgaggtatcatctgccagatcaatgtaacagatctgtccctgatatccattgcggatactgtcatcggaaagcagctgctcaatctccgctttgttaaacagaaaacggctgtttcccatcatgctggatccgagcagcgcatcctttgccatgccgtctaacgtcacagaaaacgatacgctatgatgcgtaatggtaatctgatcgcccggcttcagatgattcttttccataaaatctccggttgcataggcatgtcccggttcaatctccgtaatctgctcattgtttttgtcaaaaaatttgagccggctgtcttctacggcctggtagaccaccgagttcttagcctccaattcttttccgtccacatccttgagattggatttgtcgccccagacgaccggctccgtgcggtattctatgaccttctcctccgtacgcagcatctcatccagtgccgccccgctgtccgttcccatagagattacaacataatctccgatgcccgccttatccagataagagtcgattccgttcgtgacagaaacgacattgctgattccgctcgccacaaacattgtcgccagcagaataaaggaaagcataacggcattcatcgccttttttctttttaagtctttcttcaaaatacgaaaaaacatctaatcctccttgttttccgaaggaaaatgcgaaccctctggtgagcagaggattttcctccttgttttcctcacctttatttgatgtactcatcttacaggagaatttattaaacaatccttaaatgtcgttatgccttccgcacaactaccgtcgcacagaaatcatcgtctctgatctctgcatacacttcgccatccatcttatgcatcagctgtctgctgatatacagtccaagtccggaaccatttcccgcttctacattacttccgcggtaaaatgaatcaaatatattcacaagttcctcctgttttaatgtacagccggaatttgtgactgtaatcagccggcagtcctcttcctccgaaaaagaaacaataatccttttcccgtctccgtatttcaatgcattctccaaaagattctgcatcacttcgatcaatcggtctgcatcaccttttagcagacagtccgtatagggttccatctcaaataccgtatgcagactgccgaatttatccatataaagtttcctgattgcttctatcacatctgacagatacacttctgtcagatttacggtcagataaaggaaatcctcccttgatgcaacggtaatctcattcacgtatttctcaatatctgttacattcttctcaattccccgatatgcttccatacgtttatcttcctctgtatacaaaccttccgccaaagcccttgtgtacaggcggatggcggacagcggagtgttaatatcatgcgtcagcgataaaaccagggtctttttctctttttgcagctccagttctttcttcctgttgctctctaacgtatcccgcagcatatccattccccagaggaacctgccgaagaacctgcttttctctgccttgattggcgtagaaaggtttccttttgccagttcctccgtcagattctgcatattctgaaacggtcttatcactttctctccaacgtaacatacgaaaaaaacagacaacaaaaacatgattcccaggacgatatccatgaaaatccatgttccgtagtctgtttgtgtgtaaataattttatagatggtatctgttttttcctgcgctctctcaatacgcggttcccgggtcactgctgccatataatagaacacattcgccgccatgatgaaaaaaagttctatgccaagaacccccgccgccaattttttataatgcttcataccggtatcctgtcccccagaccgtaataatatgttttggatttttcggatcctgctcgattttctcccgcagccatttgatatggacagtaagcgtctgcatctcagactcactgtcgctgccccagatacggttgaacagatattccttcttcaacgtggttcccctgttttctatcaaaagctttaacagctgaaactctttttctgtgacattaaccggcatgccatcgaccgtaagtgtctgtgtaacactgtttaaccgcagatggtcgcagacgatttcatccagtgcatatttccgcttaaaaatcccgttgatcttcgcaagcagaatatcaatatcgtagggtttgctgatatagtcgtccgcgcctatctgcaacccctttaatgtgctctccttatccgttctggcactggcaatcaggatgtgcgtattcgagttctcccggatccttgcgcagacagaaaaaccgtccactcccggcagaccgatgtcgagcaccagcagattagcaccgtaccgttcaaaaatatcaagcgccttttctcccgtgtctgcaaggctgaccgtataattttcttttctgaggaaatcacataaaagcgtacctatttccctgttatcttctacaataataatatccggcataaatcctgtctcacctgctcccgttatttttcactgcttttctgcgcggatttcttctccgcccgggcagctacaccatctgcaccagccatacattgctccgcaccatgcggtatccgatcgccaccttaatcagctcggtcgcctgcaccagaaagtacacgctcacaatgccaagtcctgtaaaacgtgccagtacaaacgcggccggcacgacaacgatccacgtgaaaacagagtcaaacaggaacgtaaccatcgtctttccgcccgatcgcagcgtaaagtacgacgcatggctgaatgaacagaacggcatgatcatcgccgatacggcgatgaagcttgtcgcaagcgccttgatctcctccgttgtattgtagatctgtgggaaaaatcctccgaccaccagcataagacctgccacgatcacgcagcagaacacactgaacacgatcatcttgttgtctgcgtcctttgcttcttccagctcgccggcgcccagatactgtccgaccacgatactgatgcaggaaccaagctgcagatagatgatgttgaacaggtttgtgattgtcgtcgcgatattcagtcctgccacaacctccagtccgcggacggaatagcactgtgtgaccgctgtcatacccgccgcccacagaacctcgttgagcatcagcggaaatcccttcacgataatcgccttcaattcctctcccggaatgccaaatccggtataggcgccctttaaatacaggttctgtccggtatggctgtgcgcccagacaataatgatgaacgcctcaatgtagcgtgcaatcaccgtcgcaagcgcggcgccggcaacaccaagctccgggaacggtccgattccgaagatcagaagataatctaacagcgcattgcttcccacagcgacaaagctcgcaaccatcggcaccatcgtctgtcccgtctccttgatattcgtcgcatacgcctggttgaccgcaaacggaaccagtcccactaccatgatcccaagatactgcagtccatacccaagcgccacatccgtcgccccgtctccggcggtatccgtcagataaagcgagatcagattgtccccgcatgttagaaacagcagaatggtaagccccgtcacaagcagcgccgcatatagcttaaagcggaaggaatacatatgtcccttgtgattcctcttgccgtaatactgcgccccgaaaatactggctgccgaaaccgcgccgaaaatcgccagattgtatacaaaaatgagctggttcacgatggcaaccccggacatctgctccgtgccgagctgtcccaccatgatgttatccagaaagctgacgagattcgtgatcgcattctgtacaatcatgggcagcgccagatataaatatcttttataaaacgcccggtctccgatatatttttccttaaattctgctaacttcatacgttcttttccttctataagatctcttttgtgtttatctgatcatcttaacatcttcccgcaaaaaaagcactgtttttttgaaaaacagtgccatttcccgtctgccgccattgctgccactcagaacagatccagcatattgtccagataaattttttccctgacatgcagctgatacccgggtttcgtcatatagtagagaaggaactccagaatcagcgcactgccaagtccccgcccctcgatcttgaactgggaaaatcccatgggcaggtagacattttttatggcgtccgtaccgataaatcccggattagccatcgctttggaaaacagatagccgccctctgcatccggagccgcgcagtgatgctccccgccgctttctccgagatttttgcgactgacggcttcgtaacagcgcttcctgtccctgcagccaaaccagcagcattcattgcacagaaattccactttgtccctctgccatccggtcagcgtatcccattgcgcaaacgccttattcagccggaaatccggcacgacatagcggaaatcctcccggtcgatctccccgcgaagatcctcaaaatccgtcagaaccttggtggtcgaggagacaaaatagaaccccggatactgctgcttcaaatacgctaacaacagatccgagtgaacgatcacaccgtttctttgatccccaccttcctcaaacagggcacacaggtcattacatttccggtccgagagatgctcctcccgcagcagagagttgctgaacgtcagccgggcagaaattccgtactcccgcagcaacgccagaatctccgcggagtcgtgatctccgaacccgacgcggcctccgccccagagacagtccgccggtgcaccatagatcgatccgatgtcgcaccagtcgtaaaaatattccctgtgctcatagaacagcggcagaaacacgcgatacaattcataaaattcaaacagccccggaaggtgatagtatgcggtatctttttttaatgaagccatatctgcctcgtcacctcgctgattcccggtctaggcaaccgtgatcagttcgtactcgcgggttccgaaacctaaggctgcggccgcctcgatggtgtgtacgccatgtctggattcgattcgctcgagcagatgatctctgcccggatcgtcactcgcatagaccagatcaagacatgcctgatcaattgcaatcggatctgtcgaaatcaggatacccatatcctccatgcacggatcctccgccactgcacagcagtcacagtcaaccgacatatttttcatgacattgacgtaaactgcattccccttaaagtaatcgacaacggaagatgccgcatccgccatagactccaggaaagagtcgtggtctgccgtccagatatcttccggctttcctgcaccatgaatatatgccttgccggcggaagatgcaatgccgatcgaaagctgtttgagcgctccgccgtatcctcccatcggatgtcccttgaaatgggagagaaccagaagcgaatcataatccgcaaggtcttttcctacaaagttcttctgaatgactttgccgttcgggatcgcaagctccagatccggtccctccgcatccagaagatcgactttaaagtaccggctccatccatgtgcctccagcgtctttttgtgcttggcggttgtattacgctcgccttcgtatgcagtgttgcattccacaacggtaccgccaacgtaatcaatgaccggcttccagaattccggttttaaaaaattctggttccccgcctcaccggagtgaagcttgatcgccactttgccgtccagcttcttcccgagaagctgatacatctctaataccttctccgggctgatttcttttgaaaagtatacttttgctttttcactcatatacagaatccagcctttctcctgactcgatttcaacatcgctgtttggaacgtatttctatccgttacttctattccccatttgtctttcatgtattcttttccaaagtatagcacacgtatgtaaagatgtctcttatcttttttaaagaacgatactatttatagaaatatcttttgtttttacaaaacagccaaaagttttccctcataggaagaaagaattatcttttttttctgcaactgcggaacttccactgatgtcagtgtcacactgccggtgccggtatttaaaaatatcaggactttgtcgtccccaaaactacgcgaaaatacatatgctcctgtaatatcattgcagtaaattgtccggtaattgcccttgcgtaacgccacatgctcttttcggagtacaatccagcagctgaacttctctgccagatttccctgtaatctgttgttttctatctgctgctccattactgcctgccagtccatggctgcccgatactccagctctttcattccctcgatatacacttcatccccatagaataccgatggcacgcccacccccataaagagatagaaaaatgccagctccattctctttctatttccattgcaatagcttaaaaatctcggaatatcatgggaatccagaaaattcatctgtgccagactcacctgccatgggtagcggtaaatcatctgctgcatctgggcatcaaattcactgaccgaaagttctccctttccaaaaaaatcccggcacagataagaaaaagtataattcatcgtagaatcaaactggtctccctgaagccagatgcctgcttcttcccagatttcgcctattagaaataaatcctcttttactgctctcaccgcatgacggaaggttctccagaattcatgattgatttcatttgccacatccaagcgccagccgtcaatgtctgcttcccgaatccagtaagttccaacattgcaaaggtactccaccacttcaggatttccggtattaagctttggcatttcctttacataggcaaacgcctcataatccggcggatcagcgtactgtatcgtttccggcagataataaaaccagttataatatcttgatgcttttcccttctgccgcacatcccggaatgcaaagaaatctgctccacaatgattaaatacaccatctaaaataacacggattcctctcttgtggcactgctgcaccagttcttttaaatccactttatttccaagacaggggtcgatttcaaaataatcaatggtatcatatttatgataagacgccgcttcaaaaatcggattcagataaatgcagttaattccaagcttttcgatatagtcaaggttttcacaaattcctttcagtgtaccacccagatgattcttgcaaatccggtccggtaaaatttttccattgctgtcgcttttttcatccggcaaaagcatatgccttgtcgctttttccttcagttcccgtctgtcatttgcaaaactgtccgggaaaatatgatacataacaatgtcttctgcccactccgggatatctaaaatatcctctcttcgaatatatggaaactgaaaatattctgccctgccacaggacagtttctctgcaaatcctcttccataataataaaggctttctgtatcgtcctctaaccggaaataatagcataccctggtatacggagatgtaatcttaacttcataataatcataaagcatatcggatgccacatgttccatttcactttgtttcaccggaagtggctcttccatcgccacccggtctccccaatacagcacgcaccgttttaaatcgtcctttttacaacggattcttattaccagccggtcttctttttctgcaaaggcaaattgtgacagtggaatatgcaaaattgcttctttttccattttatttctatcctttcacaccacctgcagtaagaccggataccatatacttttgtatacagaagaaaataatcagcactggaacagataccaggatagcggctgcggaaaacattccccagcttctggtgtaatcgctggactgtaactgatataatccacctgccagtgtataactgttttcattcagtagaaatgttgtggaaaacagatattcattccatacaaaaataagtaccatcacagaagttacaatgattgccggacgagccagcggcattactaccttccacagcagctggaaatccgatgcaccgtcaattttcgatgcttcttcaatttctaccggaatggtatcaaaataccccttcatattccagatagagaagatgcacatgcttcccgcataaataatcaccagtcccagtttcgtgtccagcatattcatctgttttaaaagacggaataatgcaaacatggacaggatctgtgggaatgcatttaagagaagcagtaattttaaaatgccatttcttcctttaaaacggtatcttgaaaatgcataagatgacaccacggcaaatccgatagcaatgaccattgtaaagaagcttaatacggcagagttataaaaccaccgcaaaaacggcttctgcgtcagtatatttttataattatccagtgtaaattcctttggaaacaaagataatccagaggacaatgctccacttcccctttcaaaggaaagattcaacgcatataaaatcggcaccagtgccagcagacacagtataatataaaaaatatgtaatccgctacgctgtaaaatctgttttctctttttcttagtcataatttttctcctttacccctcgattggtaaacagcgaaaataccatgatgaggaaaaagataatcatggataccgcagaggacagcccatagttatttgaaacaaacgcattctgctgtgcataggtaattacggtttgtaaggttgctcctgaatatgctcccttctgcatcgtaagaagatatacgatatcaaactgcttaaatgtggtaaatgtcgtcataataaccgccggtgcaataattcctttcattgccggaacggtaatatggatgttctttgaccagaaacctgctccatccagttctgcgctttcataatagctgcggtcaatgctggacagtgcaccgtctatcatcataatcataaacggcaatgccatccacaggtttaaggtcatacaggagagaaatgccggcacattggtggaaaggaaatttacctttccaaagccaagtgccaccagaatcttattcagaagaccaaactctgtgttataaatgcctactctccacaaaagaatggacacatatgcaggcattgcccacggaaacatcaaaagggtcttgtatacacgttttcccttgaaatcttctccttgaaatcccaatgcaataaaatatgccacaactacctgtatcaccatatttaatgcggtccaaagtaatgttgtaaacagtgctccaaggaaaccggagtctgcctttaataatgccctgctatagttggatagtccgataaattcataatttgaccagtgaaaaagattcatattggtcagtgatatataacccgtataaataattgggaatacaataaccattccaatcaatatcagcgccggcatactgtaaagccatggtgttaatttccgtttgatcttcatatacacacttctcttcctgattttcctctttattgcttctaaataaactccttcttactgcatatcagcaatggcatccaatgcctcctgctgataagtttctgctgcagtgtcaatatcttccccggatttgttgactgccgccaaaaatgcttctgccggtccccacataacgctcatctgaggaatgtttggcataggctgtgcagtttctgcagttgctttcattgccataatcatctcatttgcagcaacatctgcatcatcatatgctttgctgtttgccggtgcacagtttgatttattcgccagtgcaatacctacttccgggcttgcaattgtctctaatgcttttgcaattgcttctttcttattttctgctgcatattttaagacaccaatgctctgtacaccagaatatggtgccagtccgtttccattcggaagtttaaaatccgctaaggatttaataccaaggtcaatgcccgccgccttgattccggataccagccatggtccaccgatgattgctgctgcctgaccttcattgaataatgcagttactgtgttgtaatctccatctgcctccaatgctgcaaatttctgattgtacgcgatagcatccttggtttcctttgtatttaatccaggatctgcatccttatcaataatatatccaccaaaaccattgatcaccggtgccacattgtatgcggtagaatgctgatttaccagtgcataagttcctgcatccacatcggtatgtgctaccatataatcatacagttcatctgttgtttccggcacatcaccttcccatcttgccttattatacataaagagcaatgtctcataataaaccggcagcaggtactgggtatccttataattacctgcttctacggtcatcggtaataaatctgccattacatcctcactgataacatccgtaatcggagctaaaattcccatttctgcaaatgttcccaatgaatcatgtgcataaagatacatatccggtccgttggattcatcatttccatataactgaagctggtcggtcagaccactcttcttttcaaaggtaaccttgatattatcctctgccagtttctcattcgcacaatctgcaatggtctgcatgatattctcatccccatcatgccagatttttacttctgtcatttcatcccctgcatcatttccaagtacttctgtagtctgtccttcgtcttttcctgcatcttttccacaaccggataatgcgccgattgtcattgcggtacagagcaacagactcaacacccttttcttcataaaaatacctccgttttccggtttctttaggaaaccgttttctttattttctttttttcatgcaatttgttcctcttgctaagtctatatctatcacttcttcccattgtttacaatgtttatttgtcaaaaatgattgactttgttaggaaaccgctatattgtatttgtaaatttatacatttttttaggaggtattttatgtctgttaccatcaatgatgttgccaatgaagccggtgtttccaaatccactgtttctaaagttttaaatcactggaccaccatatccccagccactgtggaaaaggttcatgcagcaattgaaaagcttcattatacccctaactcccgggctgtaaactttgcaaaaggtgctacttccaatattgtctatcttaccaatctggagaaagatactgcttatcggaatccgcatatgtttgacattatgtgcggcgtacaccataccttgtccgaaaacaactattccctaacgcttgtcaacacttctgaagagcactatcccggagaaaaagtcagcgaagttatcacaagccgttcctccgatggtcttatcatccacggctctgccattaataaagaaattgcaaatcttattctggatgcaggctttccacacattatcattggacatccgagttttgaaagctgcttatgctgggtagataccaaccacgcccttgccggtgaatatgccgctgcccacatgatagcctgtggttatacagatgttgcctttatcggagagcgcaaaaccgattatatttctgcccagcgtcaaaaaggatttatggcaggcatgttagacagaggctttcacattccggctgcccgtatcggaaataccgattccagttggcagcacacttattctgttacttctgatatgctgacacagcctgtaccgcctcgcgctattgtatgtgaaaataacaccctcgcattaggtgtcatccaggcagtcaaagaccggcagctttccatcccggatgacattgccatacttacctttgacgtctacccatattccagcatcatcgacccacagcttaccattgtagatatcaatgtctatgataccggtgtgcaggcaggctccatgatgatccgtaagcttcagaacccggagcttctcatccaaagctatacaacgcttcctgttatcatccagggagaaagcaccagaccactgacataaaaaaagtgccctcgacactctcaactctcctgacccctcattcatgaataagatcaacatcatgctctgtttcgtaagaaagaactcttgctctaaacctggtgagggttctgtcactaattggctgctctccaaaactggttgtgtgcagcgcatactgatagcggatatcaaataccctagcttcaacgatctcatcgtcagtaacattaagagcttctttaagaatcagtggcccaacaatcacattgaccggagtattaggtctggatgctttttcactgtaaagaacagaaaaaatattttcatcaatagcaggaacaactttatctgtctgtaagatgaaaagtgctgtctaaaacagtaagctgttgattatcatttttaacaaaagacatatggatgacctcataaaatgctgcctgcattttaccaaagaatccaatgtttttacatatcgtgttaagctttcaaggtacaaatttatatcaaaggttataaaccttttgacaccccaatcctataagttaaaaaaagccccgcgtgcggaactctttgcaccgggacttctcttatacatgatactttgtctgctttatgacatgctgttgacagtcttatacttatagagcatctccgcatgattctgctcctccacctgaatgtctgcgagcagtttgcggacgcccggatcggcaaatacaaacacgtcggtattatactcggaagacaccagcttctcggtaccgatacagtcagtcgcaaggaagcagtcgtttttcttgtcctcggactccgcgagggagtaggtggcggtcgggttataattctttccatcgctgtcgttgcagttgcagttcggcacggtaccgtttaacacctgtcccagcgagtcaaagtgctgctgctccttcttgtgaagatcggtgaacaggttcacgagaaccggatccttcgcctctttgctgtatcgggaatacttctccacgcaggttttctcctgggtctggagatctttgatcgccgctgtctctttttcacttaataccatcgttgttacctcttttcttatttttttctatgctggtattattgggaaaaagtttcgcaattatacacaatatttattttccggttgacaaatgcgcacggccgcgtctataatggcgttaatcggagcagaacacaggctttgacgggaagaagtaagaataagtggaacgaacagaaagcaaccggctgatgagaggtgcacggaaagcttattacgaatacatccccgagcttcacacccaatttgcatgaccgttctttttgcggtgatgtgatagtaggctgtgacgtagcggcgcacgttacaagcgcctgagtgttgtcggacactcgcagaggcagaccgtgtgaatggtctgtgaacaaaggtggtaacacgagtttataccctcgtcctttttgaaggacgggggttttttgtgcggcagcaacggtccggcactgttcggctgttgtaccgccgccagaaaaagacaaccacaactacaaccacaaagaaaggaactgacatcatgacattatacgatgaattagttgcccgcggcttaatcgcgcaggtaacagacgaagaagagatcaaagaactgatcaacaacggaaaagcaaccttctacattgggtttgacccgactgcagacagtctgcatgtcggacatttcatggcgctctgcttaatgaagcgcctccagcaggcaggcaacaagccgatcgccttaatcggcggcggtactgccatgatcggtgatccgtccggccgtaccgacatgcgccagatgatgacaccggagaccatccagcacaactgcgactgcttcaagaagcagatgagccgctttattgatttttccgacggcaaagcgctcatggtcaacaacgcggactggctgatggacttaaattacattgatgttctgcgcgaggtcggcgctcatttctccgtaaaccgcatgctgaccgctgagtgctacaagcagcgtatggaaaagggcttaagcttccttgagttcaactacatgattatgcagagctacgatttctacaccttattccagaaatacggctgcaacatggagttcggcggcgacgaccagtggagcaacatgctcggcggtacggagctgatccgccgtaagctcggaaaagacgcttacgccatgacgatcaacctgctccttaattccgaaggcaaaaagatgggtaagacgcagtccggcgctgtatggcttgatccggagaagacctccccattcgatttcttccagtactggagaaacgtggctgactccgatgtcttaaagtgcatccgtatgctgaccttccttccgctcgaggagatcgacgcaatggagagctgggaaggcgcacagttaaaccaggcaaaagaaatcttagctttcgagctgaccaagctggtacacggcgaggaggaagctgccaaggcacgcgaggcatcccatgcactctttgcaggcggcagagattccgcacacatgccgaccgtagagctttcggctgctgattttgcagagggcgatctcgacatccttgcacttctcgtgaagacagagcttgctccatcccgctccgatgcaagacgtgccgttgagcagggcggcgtgagcgttgcagatgcaaaggtcaccgatatcaagaccacctacagcgctgattccttcggtgctgacggtcttgtcgtaaaacgcggcaagaagaaattcgtcaaaatcattgtaaaataagatagtgcatgctagaatacaacaagacaaagaggggactgcattttgcatatcccttctttttcaatgataaaggagtatctgtcatggaataccgtgaggagagaaaatatttctgttccgactatcagttggagatcttaaaacaccggcttaaagccatccttccctatgatgtccatcagaaggattcatcctatacgatcagtagtctctattttgataccgcagacaatcagtgctattacgaaaattctgccggcgtggatgacaggaaaaaatatcgtatccgtatttacgatcattctgattcaaatatccggtttgagatcaaagaaaaattgcgtggaaaaacgaaaaaatctacagtcccgatcacccgcagtcagtgcgaggatctgattgccgggcactttctacctgcagataatgattcttccgttctcagtcagatttacttaaaagagcacctgcagtttctgcaccctgccgtcatcgtcgaatacgagcgtactgcgtttacttatccgatcggaaatgtacgtattacattcgaccggaatatttccgcaatcgcagatccatcgggtttcttttcggcacaaaatgcccgcatccctgtcctgcccacacatgagcatgttttagaagtaaaatacgatgaactgctgccggatcacattgcccagctgttagagcttgacacgttgacccagaccgcctgctccaaatattttctctgcagacaggcgtgtgatattaccaaccaattataagtatccatacgaggaggttatttatgagcaccaaagatatcatcaagaattctgttcttgaaaattttaccgctgacatttccctggcaagggtatgtatttccctgggacttgccgttgtactgtccctttacatcttttatatctaccggatgacaacgaagtccagcttctattccaaagaatttaacaaatccatcgccctgatgtccgttatcactgctgccatcgtgcttgccatgcagtcgaacctggtcatctcacttggtatggtcggtgcactttcaatcgtccgtttccggaatgccatcaaaagctctatggatcttgtctttttattctggtccatcagtattggtatcatctgtggcgccggactctatgagatcgcatttgtggcttccctgatcctgactgttctcttattcctgctcgacctggttccgacaccgaaggcagcgttacttctaatcgtcaacagttccgatgtcaacactttttccgaaattgaaaatctcgtgaagtcccacaccaaatcttttgatgtaaaatccaaaagtctcacgaaagacggtttggatcttgtgatcgaatttaagtgtaaagaaaatgaagatgccacgctccttgccacacttcatgaactttcccatgttacacatgtttctatcctgtcccatgacggagaacgccgtttttaatgattttggagattccgatgaaattcaagatttctacctatataaaagaactttttctgtttctgttgctcgttgctgcaactctgcttgtcctgatcgcaacacacaaggcatcacatacccgtacgatcgtgatcaacgaagtgtgcagcaacgatttttctctggtggaaaattctgccgggaaatatgctgattatattgaactctataatgcaggcgatacaaccatttctcttttaaactggaccctgcataccggaaaaaaagattcaggaacgtacacctttggagatatccgtctgttaccacaggctcgtgtgctgctgatccatagggatgatgccgcatccgacacagacacttccagtattaccgtctccccgaaggattccttttctctggaaatcccatgctctgtcgccaaagatggagacacgctctatctgcgcaattcctccgataaaacaaccgactacgtgactgttcctgctctcacctacaacaccgtgtatgccagagagacggacggcgcggacacctggaaaattcttaccggcactccctgtacggacaacgcatctgcctctgctcctttctgggcggacagggatgacgcgcccgcagagcccgcttatccgttaaccgatctgtcactccctgcggaagccgccgatgctgccgttttatcaatctccatcccggaggactctctctatggcgatgacggtatttttctcagtgaaaacagaactctctccggccgcacagcggaacgggaatgccaggtcgattatttctccccggatcgttccaatgagagttcgttttacagcggactgcgtgtgagtaagcggtcaaataatctgcagtgtctggattttaatctttatgcacggaatatctatggatcggatacgttttccacagattttttcggtaatggtatagaacatgacagactgctccttctacacggagcagataaacagtatctgctctatacgcttctggcacagcagaatatacagactgtctccttcctcccatgcagtgttttcctgaatggcacattttacgggaactattatctggcagaacctgtcgatgaaaactatctcaagtcttcctatggtgtctccgggaagaatctgaccatacttaccgaaaaccagctgacatacggttcttcctatggactgttggaataccgcgcactcatcgcagatgccacagccaacggtctgaccgatcctgctgcctatgaaaatttctgtgaaaagatcgatattgacagcctgatcaactactatgtgctgcacattcttctgaatgacaatgatttttcaccttatgactcctgccttgtctggcggagtgaaacagttgatccgggaaataccttttccgatggaaaatggcattatgagatcaccggactgtcccgggctctctttacccaaaacagcaatactctgaccaatacattttcccacgtgcaggatactgatccgctgtttgaagtactccttcagaaccccgatttccgtgaccggttttcggaatacttcacagatcttgctgaaaaccggctgaacgaggctgcggcagaggcactccttgccggcaccacttacccggaagaggatacagacaatctggaaggcgaattttcgcagttcttccgcgaccgctccgtatttattttaagctacctggaagatctcctcacagaagagggactttccgattagacaggagaaagaggatactcttatgaaatcatttgatcagatcaaaaaatatatttttgtactccccgcgtttcttctcttagtgggaattctgatgggaatacaatatttaaacgcaacacccgcactttcggatgaaagctcacagacagagtacgtggatgactactgcgtcactttttctgcccccagtggcttttacgatgatgatttttcactgacattatctgcaccggatggtttttccatctactacacgctggatggctcgcttccggatgagaccagcgagcactacacggctccgcttgccgtcacaaacgtttcctccccagaaaaaaagtatgcaaaccagacgatattttccgttgatggcaacaacgtgtccggcgatgtgcccgaccaggcttatatcgtccgggcagttggaatcaatgatgccggtgtatcaaccgatgttgtgaccgagacctattttgtgggctacgatggcttttatgacggttactccgttgtatcactcataacggatccttccaacctgttcgattccaaaaccggtatttatgttctgggagattcctactacgaatcgggaaatgaactggatgccaactttatgcagacgggaagtgactgggaacgtccggtgcatattgactactttaatatggataagacctatgccttttcacaggaaggtggaatccgcatcaacggaaactcttcccgcggtgattccagaaaaagtctccgcctgtatgcccgaaaaaaatatgacggaaacagcctgttcacctacccgatcttcagcaataacatctatcccaactctgttatcctgcgccgaggaacatttattaatcagtttcttccttcgctcgtcgccgaccgtaatatgggaacccaggattatgttccatgtgttgtatttattgatggggaatattggggaatttattatatgattgagcgttatgatacagattatctggcggggcactaccaggtcgatgacgacaacgtcacgattttaaaagacggggaacttttttcgggatctgcatattctctggaagactatagacagcttctggcttatatggatgcaaatgatctaagcatttcagaaaactatgatactgtatgctcacagttggatatccagagttatattgattattatgcaacccagatctatatcaataactttgatttttcggaatcgaaaaatcaggtcatgtggcgttcggacagcaccgatgctgcaaacccctacgccgatggaaaatggcgtttttccctgatggatgtcgatctgtctctcacttccttcggcggtgtcgaaaactatgccacaaacagcttttccgatacagaatcagctgtcgtaatccagacggaagagacgatgttcaaatccctgctcgcaaatgcctccttccgccaacagtttgtaacgaccttcctcgacctggaaaaccagaacttttcctacgcgaccgtgcgcgcggcgatggatacctgtcttggctatatcgacgatcctgatatgatggacgcatactttgccaaccgccccgcttatatcaacgactctctcgcagaaaccttttccctgacaggcactctcgtgcccgtgaccctctcggtcaatgacgcctctatgggagagatcctgctgaatacgatcacaccggatctatcctccggcagctggagcggcaactactacaccgactatcctgtcactgtcacagcagaaccaatggatggataccggctgaaggagtggttgatcaacggagaacacatcacagacccttccaccagcgtgactctgcccgaaagcggagccgatatccaggctgtgttcgaaccgctctcctgataaagaccggttcgtccccctcaatagtgcagcatctcgatcaaaaagagccacgcaagcccgtagtatgtcactaccgccaccagatcattgaccgtcgtgatgagcggtccggatgcaacggcaggatcaatatgaattttgtggaaaaacatcgggatcagcgttcccaccaggcttgagatcagcatggcaaggatcaacgccgctccgatacagccggacaccgcaaaggcgaactgcagggagccggacttgaaaaagtaaatgtaacacccgatcaggataattgacatcataccaaggatcagaccgttgctaagtccgacgcgtgcttccttaaagaccaggtgcactttctgcccggcagtgagattttcatccatcaacacacggatcgtcacagccagggactgcgttcccacatttcccgccatatcgagaatcagcgactgaaagcacatgacaattgtcagttctgcgaccacgtgctcgaacatccccacaacggaggacacgaccagtcccagtccgagcagcacgatcagccacggcatacgctttttgatactgtcttttaacggctcttccaaatcttcctccgcagtcagaccggcgagcatggcataatcctcgcccatctcgtcatcgaccacctcaacaatgtcctgcgaggtgatgactccgatgatccggttctcctcgtccagaactggaatggaatcttcggaataatccttgatccattcgatgcagtccgcgatctcctccgtggcatagacgaacgggtaggacaccacgatcagatcctccagattcgtgtcctcccgcgcgatgatgagatcattcagactgatcgcaccgcagaagatacggttctcatctacaatgtaaagtgtggatatgttgtcattgtctgccgcctgccggatcaactcgcgcatagcctgctttacggtcacattagacggaatctccacatagttggtggacatccggtttccaatctgctcttcatcaaaagaatcgatgagatcgatcttatgccgtacctcctcatcgagcagctccgtcagcgtctcgcgttcttttttgtccatctggcgcagcagatcggcaatttcatctgcgtccatctccgagacgactgctgcctttttcttcatatccatctcttccagatagaacggaatctcctcctcatcgatgtaggagagaacctccgagatctcctccgcatttagaatgcggtacaggcgctgccgctcggtgggattcatgtcttcgagcgccgccgcaatatcattctcatgataatccagaagtctgtcacgcatcaccttcggggatgacattccgcgtacaatcgcctcgatctctttttgatatttcatctgaacttccgtcacatcttccagtttctttttctctgtcatctgctctttcatgcaagccaccatttcctttccgatgttgtcacattctgccgggacaaaatgtgcacgcaaacaacgaacgccacgttatttatggcattctgatacagacagcgcacggctgtctccttgttttcggcatgatttgattatgttgtctggaaatattgtctgtgaatacagagcataagaaaaaaagatatcctcgataatcgttcttcgatcaaaaaatggcaggcagactgccgctcattctttccccacagacaatatgattacttcgtccgcaactgtcgtcagtcatgctgccacctccattcttattttaatccgttgctatcctaacatatttgtctcagttttgcaacgcactttttctgccagccaggttcgcaccagcggaagccagctctggcactgctcctgcacaccatagccatccacattcatggataactccgtacaggtcgataacccgtgtccgcctgctggatacatgtgaaattccaccggcacattcaccttgcgcatcgctgcgataagcagcagggaattctcaaccggcacacagtcatcggtgaacgtgtgccataaaaataccggcggcatgtgctctgtcacctgcttctccagtgagactttttccatcatctcctccgtcttctgtccctttaacagagcttcaaacgatcccctgtgtgcatactcgccagacgtgataaccggatagcagagaatcagtcccgccggacgcaggatctcatttgccacgccggctctctcggaaagccaggattcgtgccagaatacgcccagacttgccgcgagatgacctcccgcggagcatccctctacataaatctgctctttcttaacaccccattccgcagcgtgtgcatggatcagcttcatcgcctccgccaactctaaaagcgctgtcgggaacaccgccggcgcacaggaataacgcagcacggcaacatggtatcccattgcgagaaactgtactgccatcggctccgcctcccggtccgaggtccattcgtatccgcctcccggacacagtaatatgagcggccgctccttaatccgaagctccctgctcttttcctgaatgtagatacaaagtcttgcacccggctgggatccctccacctgtattgtgattgtttctgtcagcatctgtctattctccccgtcttttcttaatatacaatctggttccgcccgttctctttcccatgataaagcttctgatccgcagcacggatgatcgtttccatatccttctctccgctatactcctccagtccaaatgtcatggtgacatgaatccaatcgctctgataaggaatgcccatgccgcggattctcttcaatatatcgtgaagtacctcattcgcctgatcgccgtttttattctgaaatacaaacaggaattcctctccgccccagcggcagacttttccttccttttccatcgcctccagaaaaacttttgccagttctttcaacaccatatccccggcatcatgcccgtaggtatcgtttgtctttttgaaaaaatcgatgtcgccgattgcaactgacacatatccaatctctccggacgcatattttccggcgattttctccagatacgaccgcatgctccagcggttgtacaggccggtaagcggatcgatggacgccatgtgttccagcttctcattatattttacaagcttgtattccatctcctgcgaatctctggtaaacacgatcatgattgccgtcaattccgcaaaaatagcaagcgtattgataatctgaaaaagaacaccggtatccacagaaatatttgtcaccggatcatacctgttcgtataggcatacagaaaaatacggtacgcacatgccagtgccgcagcgccgatcttcattcccatcgttcccgcgctcacggtaaaattgagaaccagaagcacaaacacaaaatgttgtacaccgcagtcccagccatactcccagataaaaatcagaatccatagcgccatcagcgcctgcgaaaatatcgatgcaaacttcgtatgattcagataggtcgtgtaaaaagatacgagataacatcctatacacaccaggcagatcaccgctgaacggatatccttaatcgcgcagaatacagcaaacaggcttaaaaagtacagacacagcatcaatgcgctgatccgtagcgtaaccgccgtcttcttcgtctcgttctcgctctgcacgtcttttaatacaaagtcctttatcttttgcaccatagtacagtcccctcccccagaaaaccgtcctttctccatagttctatcatatacatttgaagtctttttttcaaggttttccttatatcttaagtaccatatattgtattccaaaaaacattgcatcccctggcgcaacgtcatttctttttctgatcttgatgtaaaataagataacatgtaaaaaggcgtacgatttctcgtacgccattactgacccaaaggcgactgacggatttgaaccgacgatcagggagttgcagtcccacgccttaccacttggctaagtcgccctatctctcttatatgcctattatatgcagcttcccgtcatttatgacagatcacttctgccgggaagcatcacatcagacacacagagattttaacaaaaccattgtctcccgtcaagtcatatttttaaaataaacagcatctgccgcctacggcgttccaaaaacaaatgtcacatacatcgttgcctgatcgtaagttccgtcttccttcggatcaagcactgtcttcgtcagcatatattccccgtccgtcagcgtgctgtacagccactcccatttgacatccgtgaccacgctgctgtgcgccggaatggaatagaccccctcgttaaacctgtaattgggaaccagcgtcgacacgtccacccagtcgctcccgatatatttctgcagatgaaaatcggttccgtacagaatctcctcatccgtataatttgagatcgtaaccgatgcctttccgccttccacacggttgatgtacattgcgtaaggtacttcccgttctgcctcctccgtatcctcgatcggtacaacctccgttttatttccaccgcaggctgtcagcattcccatgcagatcatcgcgatacagcctgttatccataattttctcatgaatcttcctccgataacgtcttcctttttattataaccgataagtgcatggtttgtctcgaaagattttcttatttattttacttgacaactttacttgtcatacatataattattttgacaagtaaagttgtcaatgcatggctctttgtgtcgcagatgtcacaagcagcctcaaccgtcgatggaacggaagctctggctcccggtttcttcaacacacaacgtctgcggaattggaggattatatgaacgaagaaatgacgccggattatatgaccggcacacccaatactgtctgtgcagatgccagacgacaattttcccgcatcggtctgatgtttctgattggaaccgtgctcatctatggagttcagttcggcgcaagcggaatcgcaaacgcgatcaatccggatctgctttccagcacgagctacgcgcttttgattgttatgattcctatgtatgtgatcgccatgccggtcatggcacttctgatcaagaggattccggctgtgacccttcccaaaaaacacatgaccttcggtcagtggctgatcgcttttctcatgtgctatggtgccatgtatgtgagcaattataccggtcttgtcctgacacagttgatcagtatcctgaagggaagcccggtaacaaacaccatgcttgaagtcgccacaagctccaatctctgggtgaatctgtttatcatggtactctgcgccccggttgccgaagagctgatcttccggaagcttctcattgaccgccttgtacagtacggcgagggcgtagctgtgcttttctccggcctgatgttcggactgtttcacggaaatctgaaccagttcgtctatgctttcgttctcggcctgtgcttcggctttatctatgtcaaaaccggcaatatccgctacacgatcgggttacacatgctggtgaacttcctcggctctgtactcggtgtggcgatcttgaaatggctgggagatgattttctctccatcgcttccgatcctgcaggcatgatgtcctacatgacaggaaactttggaaaactgatcgtttactttatttacattttccttttgctcggcgtggcgattgctggtattattctctttatcgtcaatctgaagaaaatccgcttcctgcctggaatgaacacgattccgaaaggaaaacgcttttccacaaccgtgttaaacgttggaatggccctctacatgatcgtctggatcgtgataatcattgtacagctcttgcaataatgaaaaaagctgccgcaggtatcccgttttatcggttctattcctgtgacagcttttattatgcaatatttactgctctttcccgcagcttctctaattttccacggtctgcccatcctgtgcatttaagatgctcataaattcttcccctgtgatggtctccttgtcatagagatatttcgcaagttcatccagctttgcgcggttgtccttaaggatcttcgccgccttctcatgctgcttccttaccagttccactacttttctgtcgatctgtgcctgcgtgtctgctgagcatgccagggatgcatcgccgccaaggtactgattggtcactgtctcaagcgccaccatatcgaattcttcactcataccataacgggtaatcatcgcccttgccagcttggtcgcctgctcaatatcgttagaagcacctgttgtaacacaatcaaataccacttcctccgcggcacgaccgcctgtcagcgttgcgatcttgttctcaatctcttccttattcatgagataatgtgtaccttcctctacctgcatcgtataacccaacgcaccggaagttctcggaataatcgtgatcttctgtaccggagcggaattggtctgctttgccgctacaagggcatgaccgatctcgtgataagccaccgtccatttttccttgtctgtcagaatcgcattcttcttctgataaccggcaatgacaacttcgatgctctcttccagatccgcctgtgtcgcataggctctgccatcacgcaccgcgcgcagcgcagcctcatttacaatattcgccagctccgctccggatgccccggacgccattctggcaatcttgttgaaatccacattatccgatactttgatcttctttgcatgtaccttaagaattgcctctctgccgcttagatccggcagttctaccggtacacgccggtcaaaacgtcccggacgcgtcagtgccgggtccagagactccggtcggttcgttgccgccaggataatcactcctgtgttgccctcaaaaccatccatttccgtgagaagctgattgagtgtctgctcacgctcatcatttccgcccatatttccgtcacgctttttgccgatggcgtcaatctcatcaataaatacgatacatggtgctttctctttcgcctggcggaacaggtcacgcacctttgaagcgcccatgccgacaaacatttccacaaattcagatcccgacatcgagaaaaacggtacgttcgcctctccggcgacagccttcgccagcatcgtcttaccggttcccggagggccgacaagcagaataccttttggcatggatgcaccaatctcccggtacttgtccggattatgcagataatccactatctccgtcagattctccttcgcttcatcctcgcctgccacgtctgtgaacttgattccctccgaagactttacgtatactttggcattcgacttgcccataccgaacatcatcgcgttcccgccgccgccggctttgtccatcagacgcttgtacataacctggccgattatcatgaaaatggcgatcggcacaatccagcccagcaatgcgcttaaaaacggagacatctgctctacaatctgacttgcaaactccgctccggaatcatgaagccgctgtaccagatccggatcattcatcggacccgtcttgtaaatatttccatccttgtccgtaaagacgatctcactctcatcgatctcgacttttgcaatctttttatcttccgtcatggtcataaacgttccatagtccacttccctgacctgacgctctgccatccacggaatcgccataaaattcagcatcatcaacagcagaaaaaccataacataatagaagatcagaggttttttcggtgtttttacttcattcatactgactcccctttcctgtttattctcttatatattgtgataattttaacacggtttctaaacagtgtcatattatatttttataaacaaatctaaaaaatttgcgatccgttttccacacaatccagatgcagagtgatttttaaacaaaaaaagatcccgaaaaaatcttcgagatctttacagaggcgactgacggatttgaaccgacgatcagggagttgcagtcccacgccttaccacttggctaagtcgccatatttaagcacggacagaataatgatgcccgctttacaaaattactgataaaaaaactccccgagtaggactcgaacctacgacagcgcggttaacagccgcgtgctctaccgactgagctatcgaggaatactaactgaaagatacaaaatgacacaaaatgacgtagctagtacgtcatttactatataacaaaattgttataattgcaatacttttttaaattgtaccttcaaaacttcatacagaaatcatccaacaaactttttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactttaattcgctccacatcacgtcttcggattgcctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcacttacgtgattccacagcttcggtgttgtgttttagccccggacattttcggcgcaggacctctcgactagtgagctgttacgcactctttgaatgtgtggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggataccgccatgtcatctttcctttcgcttacggggctttcaccctctctggcaggctttcccaaaacctttctgctaggattgacaaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgaggtatgctcatgtgggtttccccattcagatatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttggtttggtcgtaaactttgtttacgatattctcggatgtcttgataaaaaatctttttcatcaaaatcttctgtatgaagttttcaaggtacaatagcgaacttcgttcgcattagaaattgcttcgcaatttccgcaacatcggcatttttcaatgcttttgttactgtctgactgaatgtttatcagtcattagaaacctcaacgtattgaaatctctaatcactggtaaaaccagttttatcagaacaacactaccctgttggaataggttagcaccaggtcgtctgactcttgatgcccgttctatatagaaagcttttcagcttgtttgctttttaatctggcagccacctgctttcccataccgtcgccagtatagtatcatcggccgcttaggtcttaaccatcgtgttcgggatgtggacgggtgtttcccctaagcgcatcgccaccagaaatatgaagttttcattcggactgctcattgttctcatgactcgctcgacttcgtctcgctagagtcattcgtccaatccgtcttcgcatctgctccaattcgcaagcaagcttgcattgtcgcatttgctcatccggcagtcctcattgataactaaacagtgaacaaacactctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccaaaccgctggctactaagaataggggttgcgctcgttgcgggacttaacccaacatctcacgacacgagctgacgacaaccatgcaccacctgtcaccactgctccgaagagaaagtacattacatactctgtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaataatctggcttattcagatgttactctgaatttactgttttaggttgttctttataagaacgttcgtccgtctttcaatctcttgatcgacagcttgaaatttaggatctttcaaggtttattcactgttcagttatcaatgtgctttgttgtcatctctcggcgacagcttatttactataccatagtatcaaccgtttgtcaacaactttttttattttcttttgcttctttttcagaagccgttgttgtctgtgttacttattttacgcgacaactcattcataatatcatgtatcgaagcgtatgtcaacaactttttcagaaaaaaattgaacaactcatatcttcaaataaagcggagaaggagggatttgaaccctcgcgccggttaacccgacctatacccttagcaggggcacctcttcggccacttgagtacttctccaaagttcttatctgacaatatgatattgttctgcgccgtgacgcatagataataatactagaagtttctccgtttgtcaatggaaatattcaaattttattttcaaaggaattgccgctataagcatagcgctctttagggcgataagtaatattactaagaaacacaacttcgggatttcatgtggaaatgcaaatggaatattcgttggagaaaaatgtgagcatttcttccggctgaatgtttgcatcggattccgtgtctcttccacgtttggacaatccgacgggtgcatgtccggcacaccggagacaatgggcggactttctggtgtccctaatggcacctcttcacagacaatataaaaccgcgcgaaccgaactcgccagcatctgctattgaaaatagggcagatgccgactcagacagcggcttcgcgcggttatgttttgttcagaggtgccaataagggacacacacaaaagtcctacaaattgtcttccgggatacggacatgacccgcggagtgctccaaacttggaaagacacggatcatcgaagatgcaaacatccggctggttagaaatgccacattttttgaaccgaatttccatttgcatttccagctgaaatcccacggtgtggtctttttataatattacttatcactccaaagcacgatatgcttattgcgacaatccattcagcgtatttttattattcgtctctttttcttatactatagaaagtaaagcttccatctatgaggagcgtctgctcatcgtttaacagttctacccggacaaccgtgatcttccttccgtggcgcagcaccctcgctttgcagtagacatactctgtatgttccaccggaagcagataattcatcgacgcatccagcatggtgacgtattccctgtaagtggatgccgctatgccggatagcgtgtccgcgagggaatatgcacagcctccgtgcattcccccgtagatattctcgtattgctttgccagacggatccgcccaagcgcatatccttccgtcacttcgagaagttccatgcctatatgctgtgcaaacggattcttccgcacgatctctttcatatcctcaaacgtttgattcattaccactcttactgccgctttcatccccttttgccgcaaagaactgcaaattcattggcatcaattgggaattacttgctttcttctgcgcattaagcctttcctgggttctccagtcggtgttgacattatctcttggggaagtcgctgtgtaatcaggaccgctcttctttacattgttggcagcatagttctttgccctctcctcaccatggacaatctcatagtttgccagcttcttcgcatctgttgcattatatccctgactcttgtacttattgtataagtcctgtttcgagtttgcatcaggatagcactgcgttgcaagctttgctgtatccgggtctgcccctgcattaatgtactgctgttctttcctgctgtatgggctgttctccttcgttccatgtcctgtcgggtcatggttaaggatcgggttattccggcagtaggtatacaggttcagtccgtcgccatagtaggtatcttcctgtgtgaatctggcaatgacagggttataatatcttgccctcaggtaatactatcccgtcagaggatcgtactgctctcccatataacggaagcggttctctacctgctccttgcagcttatggtattcccaaaggcatcatactcatattgattgagtattctgtcctgctctcttccctgtgctgatactccgctctccttatcctcatctctgatgatatggctcacactgccctgttcatcggatacataatggtaatacgtcttggcgttctcgctgtcagaactgattaagcccagtccacgtatataacggatgatgttgccgctgcagtctttctctgcgactacttccctatcctcattatagaggaactgcactaatctgccgttctcttccatctctgcacgaagaccctcggcatcataacagttcttctgaatgtccgaaagtataaccctgattataactattttaaatattcatttgacttaaatatatactttttcataagttccgctcttttattatctagttctgatgttccaatttgaacatcaaacttaaagaaaaacctatctgatatttcattttctaaagatttcaattcgtctttatctgtatgattctttaaaaaatccatccaatctctggcttcattttcattctgaatcaataaataatctttttcctccttcttcattaattcaatagtttctattaactcactcaatattactattaattcgttatgtttttcgtcgtcaatcttgttcataattttctcacttccacgttgcaggtgttatctcaatccaatctgcaggtactgctctataatcaatatatgcttgatgtgccccaccatataatcccattccttgtggtccaacttttccttctaaagctcctaaagaagaaccttctggtatagtcatcttatataaagtagatgcatcattacagaactcctgtttaattgcataatccactctccattgatattcagttgcaggaggtggttctaaactccaaaatccgccattttttccaccaattctatataatgtagtcccgccttcatacgtagtaggtgttgcttttcctcctgcaaaggaatttaaaacatttcgttcccattgtgaaccttctggtaatgttggtactcctacatttttttgtgtcaaactagttgttttaccactcttctcccggatatttcatgttccactctttgcgcagaccggtcatgagttccatgacgtcacgggtatcttttaagcgcattaccccggtatttccgttcaagatagcatcttccatgtctgtcatttcatacaataatgcatccgccgttgcacctgccgtgatctcatgcacctttccggtctctgcttccacaacgatagcacggtcggcgcgcggatattccatgatctctatatatcctttttcacagctgattacagcgcgctttggctgtttggagtgtagggacagcgacagcgccgccatctgtccgtccggattcatcagaagaattccctcctgttcatccgcgccggtcggtgcgtattttacctgggaaagtacttgatcaggctggcttgacataaagcttcttgcaatggaaagtgcatagacaccgatgtctaagagtgctccgcccgccagattcatattgaagaaccggttcttcatattatattccttgtagcttccgaaattgagctggataaactgcaccttcccgagtgccggaatctctccatcccccgtctcaacaatctgccagagcttcttatataaaggcatatgccagatcgtcatcgcctccgcaaacacaacatggtgctcctctgcaagcgcaatcgcctccgcaagctcacggctgtttaacatgactgatttttcacagagcacatgcttcccgcctgcaagtgcctcgcgggcgaattcgatatgcgtattgtgcggcgtggtaatataaatgacatcgacgtcgggatcatggaacatttcctgaaaatcgtcgtataccttctgtacaccgtacttctccgcaaatgtgaccgctttctcatgtgtgcggttgccgaccgcgtagagatgctttcccatatgctctaaggcctgtgccatttcatttgcgatgacaccgcatcccaatactgcccagttcaactcttttttcattgtggtacctcctgcatgattttactttttttatcaatacaaatcaaaaatactcatctgtggatctttccaggaacgctggattgcatcttttacaatgtctgtgctctgcacatgcccgatcagaagcggcgagcggggatcatgctgcagccggttctcccggacggtgcggctgtcatagttggcatagcagtacagacattcatgtccgcaggtgttataagcaccgatgtctgcgccgagcaggcaggagcactcacctctcgcccgtttctgctgtggcaccttcaatctgcacccgatggcacgttccaatacagactgcgataaacaaccgtccgcatccacattctgccggacaagactgcggttctcacagcacagatgaatctgaagatgctgcttttccgctatctcggaaaacgccgcaatcagacgctcctgctgctcctttccgacgctccttacgcccggaaagttccgcctggttttttcatataaatcaataaaactcaccacgcactgcccggtatatccggacagcttctctgcaaactccccgaacttttccacatgatactgctcggtgtaggtctcatttaaaaagacgggatcataacggaagctgacacgttctcttcccacgctctccgacaatctgcaaaatgcctccgcgacgaggttcttatcaggcacacgaggttctatctccctgccgtaaggcgtgatcgtcacaaaccagaacatgataaacgcatccagcagcggaaggcggtccagcataggcagcggatttttcgtacagaatacaagtgcatccaccaccgcagggtcgatccggtatcttgttatctgcgtgggataatacggattgcgcaccagaacttctcccgcgcggacccgctcatagaaccagtcgctgtaatacgccggtatgtctgtcctgcttcctgtattcagtatcatacccttcacctccgcatatccagattataccctattttttcctgtttttcacttctgaattttgctccccggacggatggtatccttcccgaaattgattttatgtaaaccttgacttctcctgccggcaaagttataatgttagagttgactaactcattattttacctgatttcaaaaacggagggcggttgcagcggcaaccggaaatatatgattattgaaacagctctatatcaggatgtactggaacattccagtatcttccgccaattaccaaaagataaatatcccaatgtcctgcgctgcttaaatgcgcgcgtggtcgattatccgcaggatgcatccatcgccgcactcggggattcctccggctgctccggcattctgctcaccggcatgctggaagaatatctggtcgacgaaaacgggaaccagatcatcatcaatcatctgcgaagcggcgatgtcttcggcgccgagtctgtgtgtgccggacaggtagcgagtcatgtctacattcacaccgtggaaaaaagcaagatcctgatgctcgattttgccgcgctcttgtcggaaaaaacattttcctgctcctgccgtatgcaggtcaccaccaatctgatgcaggaatttgcgcgccaggtgatgttttttaacagcaaaatacggattctcagtcagaaaaagctgcgggacaagttaaagatctatctgcagacgttagagatcgcaccggacggaacggtctgccttccttacacccgcagagaactctcggaatatctctacgcggaccggagcgctctctcccgcgaactttgcaaaatgcgcgacgaggggattctgaatttttcgggttccaggctgcagattcttgatccggattttctggcaatataatctttttttgaggcggttgcaatagcaaccgctttttctttccttttccagtattctatgtctcgttggttagttttaactaaccaataattacatactgataccgttcagagggaggaactatgataaaaaagacaaaacttaccgctgcattattgacagctgccatggtactgcagcttgcagcctgcggaagcaatgcggcttccggaacagagaatacttcagataacggagccacagcagccaccgagactgctgccgcttccgaatcggcggagagcgtagacactgaaactgctgccaccgaggacaccggcacccacaccgtggttgaccatgccggcaacactgtggaagttccgaatcacattacccgcgtggtcatcgaccagattccgattctctccacctacatgtcctatttcggcggggaagctccttatatcgtaggctactgcggttctttcaaggataccatctcaaagacggttctcaaaaatatcgcaccggagctgatggaatccgcggataccgtctatgcacagagcgatctgaatatcgaggaaatcatgaagttagaaccggatgtcatcttatacaatgccggcaatacggcacacgcggagatcttacaggagagtggcattccgtgtatcggatttgcaaccgtcggccacgagacagaagctgatccgttaaaccgctacaaacagtggctggatcttctggaggatgtcttcggtgaggaaggcagaaccgatgctttcactgctgccggcgacgagattgttgcggatgtggaggcaaggattgcaaccgttccggaggatgagcgcccgagcgcactgattctgtggaaatacagcgacggcgtaccacaggtatccggcaacggaacctttggtacctactggatgaaacacttaggcgtcacggatgttgccgcggaggcaaccggttttacacaggtaagcatggaacagatctatgagtggaatccggatattctgtttgtcgacggtccgggactcatcggtcttacctcggaggacgtgctggagaacagggtagagggaaccgatttctcctccatcaaagctgttcaggacggacgtgtctatgacacaacgctcggcatgtggaactggtttacaccaaacccggacgctccgctggtattcgcatggcttgcatgcaacacttacccggaagttttcgcagactatcctctggaggataccatccgtgaatattaccatgactggtatggctacgatgttaccgatgaggaaatggaggaaatgcttcagtactgatgaatgataattttttgatcaaacgggggcattttacaccgcttgccattctcttcatgatactgctgccgcttgtcaccgcactgatctgtatctgcctcggcagaatgaatgtgccggtcggcgacgtgatcgccgttttccgcgatgttctcacgggaaatgaaggacatgcgcagaattactccattgtaatcaatctgcggctgccgcggattctgatggcaattattgtgggagcaggtcttacctgcgcaggaaacacgttccaatcgctgttttccaatccactggcaacaccggacattctcggtgttaccagcggcacctgcgtgggagcgatccttgcgatcatcctttcctgcggtattctggagacacagctcattgcacttgcgttcggacttgcctccgtattttttacgttaaagatcgcaggaaaaaatgagaaccgccaggtggtctatcttgtgctggcaggcgtgatcgcctcctccctgtttaacgccatcggctctctgctgaaatatactgccgacccacaggacaagcttccggaaattacttactggctgatgggcagcttcacaagcgccacttataaaaaattgctgatcggttctccgctcattctcattggaatcgtcgtcatctatctgctccgatggagactgaatattttatccttaagcgaggatgaagcgaaagccagcggcatccacttaaaacggacacagatgatattcatcctggcgtcgacggtcattaccgcctcggcggtatccatgtgcggtcaggtcggctggatcggtctcttagtcccgcactgcgccagaatgcttgtcggaagcaacaaccgttatgtggttcccatcagcttaagtctcggtgcaagctttatgattctgattgacacactttcaagaaccatcagcgtcatcgagcttccgctgtccattctgaccgccatcatcggagcaccggtctttatttcactgctgaataagaacaggagcaatctgcaatgattcttgaaataaaaaatggctgttttggatatcccaaacaggatataatattacctgatatcaatctctcattagaggaaggtcatattttagcaatcttaggtcccaacggtatcggaaagaccacactattaaaatgcatgatcggtctgctcccctggagagagggtgcgacttttctgtacgggcaggacatcaaaacattaaaaccaaaggaattgtggagcaatgtctcctacattccgcagagccacggttttgctttttcctacaccggactggaaatggttatgctcggccgctgttcgcatcttggcgtttttgaacagcccggcagacgggagattgagatggcggaagccatgatggagaaaacaggcatcacgcatcttgccaaaaaggactgcaaccgcatgagcggcggagaacttcagatggtactgattgcgcgcgcactgatcaatgaaccgaagctgatcattctcgacgagccggaaacaggtcttgattttcacaatcagattctggttctcaacatgatcgaccggctctcccacgaggacggcatcagcgcaatcatgaacacgcactatccgaccaacgccatgtctgtcgccgacgaggcttttatgatgaatcacaaaggcacttttttctacggcagcacggagaaggttctgacagaaaagaatatttccgtgtcctttgacgtcaatgtggttgtcaatgagttcagccatcatcaaaaaaaataaagagcatcgtacctgtctccctgacagacaaagcgatgtgacagaaaggatctactatgtcagaaggcgtatttaccatcgcagcaaagcgtccgatccgcgaggagatgaccatctcacgaaataccggactcggcacttccaattccgctacctggttttccctgggcgcaggcacatccatcacaccggaaagctacgatacgatgtccatctatatcggagctgccggcaccggaacgtttctcatcggtgaacagccggaaacaatggatctgcacccggatgagatattgctcgtaccggagagaactctctgtggtgtcaaaaccggcgagggttgtatctatacagaaattattacaaaaaaggagaacactatgaacgatcttgtaaaaacaaaagaggtattgaatctgaaggaactgatctcttacgaggagggaagcattgcaaacgtggatatcgtacacaacgacacgatgaagtttgtcctcatggcattcgatgagggtaccggactgacaccacaccgcgcaccaggcaacgcaatcctgaccgcgcttgagggtacagctgtcatcggatacgagggtaccgactataccttaaacgcaggtgagagcttccgttttgagaagaacggtctgcacagcgtaaccgcaaagggacgtttcaaaatgtctctgctgcttgttctggaataagaccggaagaaaaaagagccgaaaggctcttttttgttgcaggaaaatgacccgctacatttcttctaatgtgtgatactgtcggattgctgtctcgtagaggttgtttccctcgcggtcgatcacgacgataaccggaaaatcttttacctcgatcttgcggattgcctccgcgccgagatcctcatagcatacaatctcagattttgtgatgcatttggaaagcagtgcgccggctccgccgatggctgcaaaatagacggcgtggttgcggatcaccgcgtcaatcacttcttttgagcgctttccttttccaatcattgccttttcaccgagatccaacagtctcggagcgtatttgtccatacgggtggctgtggtcggtccggcagatccgatcggacgtccttccctggcgggagacggtcccatataatagatcgtcgcatccttgatgtcaatcggaagctcctcgccccggtccaatgcctcgatcatgcgcttatgtgccgcatcgcgcgccacatacatggttcctgtcagatagacatagtccccggcttttaaatctctggtaacctcttccgtaattggtgttgcaatatgtttatccatatcttttcctctcatcatcctgcttatcaacatttcattttctgtttgtggaaaacccggcatattttctcttacagtgttcttacaacgtgccggttcacgtggcagcagatattgacagccaccggaagtcccgcaatgtgtgtcggataggtattgatgttcactgcaagcgccgtcgtcgttcctccgagtcctcccggtccgattccaagctgattgatctttgaaagcatctcttcctcgagatctttgacataggggatatcggaatgttcatcgaccggtctcgtgagcgcctgcttggcgagaagcgcgcatttttcaaatgtaccgccaatgccgactccgacgaccatcggcggacatgcattcggccccgcatcctttacggcggtaagaatcgcatgcctgactccctcgatgccgtccgccggttttaacatgaacacgcggctcatattttcactgccgaatcctttcggcgccatggtgatctttacctgatcgcccggcacgatggaataatgaatgactgccggcgtgttatcttttgtattttcacgaatgagcggatcaccgacaacggatttgcgcaggaatccctctgtgtatccctgacggactccctcgttaacggcatcctcaatcgctgcgccctcaaaatggacatcctgtccgacttccagaaagatcactgccattccggtgtcctgacagatcggaatcatctcctcgtccgcaatctttaaattgtcctgcagctgatgtaaaatctttttcccgagttcagactgttctgtgtcagcggcatgcttcatcgccgcatccatatccgcggacagataatgatttgcctgtatacacatttctttgatattttttgtaatctcatctgtttgaattgttcttatcataccgttcttcctctccctgtctgctgtatatgtggcgtttaggatgcctgatcttttttgttttcgtctttctttttgatattaaagtgaatcttgaatttttccagcgtctcgttgttatcccgcgacttcatatccgggaatgccttcatcagacgctgaaaaccaaagcttttctcctcgtacagcttctcgtagcgctccataagttctgcacgctcgcgctttttctcctcgagtgcaagttcgcgttcgcgctttttctcctcacgggaagctgcataattctctgccttctcggcaagcttgttcttcgctgtctgcggcagttccgaaatactctccttggtctctgaaagcttatccttcgccgctcccgtcgtctccgcaagcttatccttcgctgcccctgtcgtctccgcaaatttatcctttgctgctcccgtcgtctccgcaagcttatccttcgccgctcccgtcgtctccgcaagtttatccttcgctgtctgcggcagcccgtaaatattttccttcgtctcgctgatcttatccatcagctccacatgtgttttctggaatttctcggatttttcaataacgtctgtcacattttcatagatattttcgccgatctcatcggacagccggtgaatagacgccgccatctcatccatgacctttaagcgcttattgaatttcagaatcgtcgtgaccgtgatgatgcagtctgccgcgaacacgcacatgataatactgagcagcactacgccaagcacgaacggaataaagcgtatggctgcataaatgatcggatgaatgatatccatgataaaggtacatgccagtccccagtagatcgaaaacttcaggcagacgtaacctttgatgttgaatggcttgtcagaatagtcccaccacttgttgtgaaatactttttccagaatataacccgtaatgtactccagcacagaggtaagaagaaaagatcctgcaaacaggatcagcagattttctttcagaggtgtcaggatggccaccacaatcaccacgccgcacccgtagatcggacagtacggaccgttcaaaaatccacggttcacgaactttccggtatcgagtgctgcgtaggatacctcggtacaccagccgataaatgcatagataataaaaatccagaccagttcataaaaattctgcggcataatcattctcctttgtcccgtgctttctccacgtactcataagaatcattatagtccatagaattttatgaaacaatcctatattatccgatttctccgtgtttttcgtaatttgtcacctttgtgactttatttttctcatccacgaaaagcaccgttggacgaagctctgatgcttcctccggcgtcacctgcgcgtatgccatcagaataatcttgtcgccggtctgcaccatgcgtgccgccgcaccgtttaagcacatcacgccgctgccgcgctccccggcaatcgtgtaggtctcaaagcgggagccgttgttgacatccacgatctgtaccttctcgtattccaggattcccgcctgctccagcagatccatatccacggtaatgctcccgacgtagtctaattccgcttgtgttactgttgcgcggtgtatttttgcttttaacattgtaattgtcatcgcttagttctccaattcatacataaaattatcgatcagtcttgtctttccgatatagactgctatcgcggcaaggattcctctgtcgatcttctccacctgctgcatcgtgtcaagatctacgatttttacataatcaatctttgcaagcggctctttttcaatctccgctgtcattgaggcaagaatttttttgcagtcgcgctctcccttttccaccatctcttttccgaggaagatggaacggctcaacacaagcgctgccttccgctcttccggcgacagataggtgttacgggaactttttgcaagtccgtcctcctctcggatgatcgggcagccggtaatcgtaagcggcatgttcagatcttttaccattctcttgataaccgcaagctgctgcgcgtctttctgtccgaaatatgcgcggtccggcgtcacaatattgaaaagcttcgtcacaaccgtgcacacgccgcggaagtgtaccggtctgctgagtccgcaaagctccttggtcagtacatccatatcgacataggaatagaactgatccccgtacatctcctccggcgttggatggaaaatgagatccacgtcgtgctcctcgcagagctttgcatcatgtttcagatctctcggatagcttgcgagatcctccgtcggcccaaactgcatcggattgacaaaaatactcacaacgactctgtcattctctccggctgcatcgatcaaactcatatgtccctcatgcaggtagcccatggtcggcacaaaaccgatcgaaagtccttcctttttccactcctttacctgtgctcttacttcttctatggttgatacgattttcataatctgctcctttcgccattttttatatttagtataatttatcaatcaccgagtcatcgatcttaaagcaatgttcctcgcccggaaatgttccttcttttgtctctttgatatatgctttgacgccctcgcgcatcacctcgccgacattcgcaaataccttcacaaacttcggacggaaatcgccgtacatggcgagcagatcctggtagacgagcacctgtccgtcacagcctgctcccgcaccgataccgatggtcggaattgtaagttcctctgatatcttagctgccagcttcgccggcacacactccatcacgaccatgcaggcacctgccgcttccactgcttttgcatcagccagaagctttttcgctgcctccacatcttttccctgcactttgaatccaccgaatgcattgacagactggggggtcaatccgatgtgcgccacaaccggaatggatgccttcacgatcgcctcgatgtgaggtgcaaattccacaccaccctccagctttaccgcattcgcgcggccttccttcatcagtcttccggcattgaccactgcgtcgtacacggatgtctggtaggacataaacggcatatccgcaactacaaatgcatcttttgcaccgcgggagaccgccgccgtgtgatgaatcatatcttccatggtcacagagagcgtatcctcatatccgagcattaccattcccaatgaatccccgacgagaatcgtgttgacaccggcttcatccatgatctttgccgtcgtgtaatcataagccgtcaccatgacgatcttatcgtgttcttccttctgcttctgtaacgtcaatactgtgtttttcatgtttccctccacttttcctgcgccccaggcgcatagactgtgttttcatgtttacactgtttccgcgcattccgcgcccgggctgtgttccccgtctctgcacaattttctcatctccgtgtaatcacgatccggatgcttgctctgtgcgaaatctgtgagatattcagcacaggaagtatatattttccgctgtttttcatttaacgcggaaatatgtttttctacggtagcacagtcatttctctccagcggacctgtgagagactgcacgcatccctgtgtcagaatgtgatccagatttccctttgcaagtgcatagagctcgcttcgcgcttcctcctgtgcgaatccgcagtcgagaagcagctgctcggacatggaaaataaggcagtcatatagttggatgagattgctgccgccgcgtgatatttgattttgtcttctttggaaatgatacgggtgcgattgcccatggaatggaaaaatgtctccagatccttcacataggaggagtccccctcgagtgtgaacaatacgccggataattctctccatgcattttctttgctgctgattgcagcaagaggatgtacggaacatgcatgacagttcatgctgtcccagtctgaaaagatgtctgaactgtaaagaccgctgcaatgaccgatcactttaccggatacatagggctttgcctgctgccacacttctgcgatggcggaatccggtacagtaaatagaatcatgccgcaactgctgatgatttcttctaaactttcataacaggttgtctgtgtaaatgctgctgcccatgcagcagacgcgcgggtcaggctgtaataacctcctacgttcctgcccttttctttaaaatatttgccaagtgacacgccgaccttgccggcaccgataaaaccgatctgcatacgttcggtctgtacatcattcaatgaaatacaaacgcctcctcccggaagcagtatgcggcacctttcctgtgaaatcatggtctcctcgatccacgtcccgtcggaaactggcggtctaaggttcgttctcttttcttctacggtatcatttccgcgctgcggaatatcatccgtgatttactataacacctggtatttcaaatgtaaataaaggaataagaaaaacccgcggtcttttgaccgcgggttccgatacatctttaatttttagttgtttcccttataagacaggaattttacaactgcaatgatcgggatcagaccggatacacagccgattgcctgtgtctcgctctcctgcttaccctctaactttgcatacatcttagcgtagctgcatcctaagaatacaacgtttaatacgattgtgatgacattttctaccgtgccgtttaccgggatgaataacagtgcaaccggtaaaatccaccagagcttgaataccattgccggaagttcaaggcttccaaataactttaccttctcgccttccccctctgctgctgcatccgcacatgcataaaatacaccgtatggaatccatgcaagccatgcatttttgtatcccagtgcctttaatgccttcatgtgggaaactgcatataacacatagcatgctaccacaacaacaagacataacagaatgacaccgatgcttgctccaagaattgctccataagtactcatataacctgttcctccttaatagtaaaatctctcttcacactctatcatatagaaaaggctatacgatgtcaaatatatctttatatttttttatactttttatttttcttttatttttagaaaaatgcttattccttgtcactgtcatctctggcatcgtcttcggcacgtttcaacagctcttccatcagctcatcatccgtctcggaattatccgcttgaccggctgctttcttcgcattttctgctgcaagagccgcgcttgccgcctcttcctcatcggtcagaagctcagaagtatcggctgtctcaagctccttattttcgcgcaccttcgcaatgcttgccacagtcacattctcgtccagattgatcagcttgacaccggaggtaatacgtccaagaagtgccgtatccgctaccttaatgcggataatgataccctctgtcgtgattaacattatttcattgtcatggttgactgccttgacaccgacgatattacctgttttctcggtaatcttgtagcacttcacacccttaccgccacggttctgtgtggtaaactcggagattaacgtgcactttccgagacctttttcggaaacgatcatcagggaatctccttgggattccatctgcatgccgacgacctcatctccgtctgtcaggttcataccaatgacgcccatggatgttctgcctgtttttcttacgtctgtctctttaaaccggatacactgtccgtatttggtgacaaggaaaatatcctgattattatcggtcttcttcacctcgatcagctcgtcgtcctcgcgcagattgatggctgcaagacctgtctttctcacatttgcataatcggtaatcggtgtcttcttcacgatacctttctttgtcgccatgaaaaggaaatgtccctcggtgtactcccgtatcggaatgaccgcagtaatcttctcgcccggctgcagctgaagcaggttgatgattgcggtaccgcgcgcggttctgcttgcctctggaatctcataagccttcatgcggtatacacggccggtattcgtgaagaacatcaggtaatggtgcgatgtcgtcatcagaagttcctcgatgtaatcgtcatcaatggtctccattcccttgattcccttgcccccgcggttctgcgcacggaaattgtcaaggctcatacgcttgatatatccaagcttcgtcatggtaatgacggtattggtaaccggaatcaaatcctccatggaaatatcatattcgtcaaaaccgatggatgttcttctgtcatccccgtacttgtcggcgatcagaagaatctcctcacggatgacgccgagcagctttttcttgtcggcaagaattgccttcaactctgtgatgcgctccatcaattccgcgtattcgttctccagcttctcgcgttccagacctgtcagcgcacgcagacgcatatccacgatcgcctgtgcctgtacgtccgtcagcgaaaaacgctccattaagcggtcttttgcttcctgggtgttcttgctgctgcggataatgttgataacttcatcgatattatcaagtgctgttaataatccctgtaagatatgggcacgttcttccgccttgttcagatcatatttcgttcttctggtgacaacttcttcctgatggatcaggtaatagttgagcatctcgtaaaggtttaagaccttcggctgattgtcgacaagcgctaacatgatcacaccgaacgtatcctgaagctgtgtgtgcttgtacagaaggttcagcacgacattcgggttcacatcacggcggagttcgatgcagattctcataccctgacggtcggactcatcccgcagatcggtgatgccgtcgattttcttatctctgacaagctccgcgatcttctcgatcagacgcgccttgtttaccatgtacggaagctctgtcacaacgatgcggttcttgccgttctgcatcggctcaatgctggtcaccgcgcggactctgacttttccgcgtccggtccggtatgcctcgttgattccggcggttccaagaatcgtacctccggtaggaaaatccggtcccttgacgatcgtcaaaagctcctcgatatcggttccgcggtcttccaacacctgattatcaatgatctttaccacaccgttaataacctcgcgcagattgtgaggcggaatattggttgccattccgacagcgatacctgtcgtaccgttgactaacaggttcggaaaacgggacggaagcactgtaggctctttttctgtctcatcaaagttcggaacaaaatcaaccgtatcttttccgatgtccgcaagcatttccatggaaatcttggaaagtcttgcctcagtgtatcgcatagcagcagcgccgtcaccatcgacggaaccaaaatttccatgtccgtcgacaagcggataacggaatgaccagtcctgtgccatattgacgagtgctccgtagattgagctgtcgccgtgcggatggtatttacccatcgtatcaccgacgatacgcgcacatttacggtgcggcttgtccggtccgttgttcagctcaatcatggaatagaggacacgcctctgtaccggcttcaaaccatctcttacatccggcagcgcacgctgtgcaatgacactcatggcatagtcgatgtaggaactttccattgttttcttcagatccacatcatgtatctggtcaaaaatcttgtcatccataggatttttctccatttctatcaattacatcatactctgtacagtccgtctgtcagatatcaagattctgtacatactttgcattttcctcgataaattcacggcgcggctctaccttgtctcccatgagcgtcgtaaatgtcacatcaatctcagaagaattctcttcatcaatcatgacacgctttaagatacgcttttccggatccatggtcgtctcccagagctgctcagcatccatctcaccaagtcctttgtatcgctggatcttgttgttgccgtcgcggccgatctctgtcagaatactgtttaattcattatcgtcgtacgcataccacacgttcttgttcttctcgatcttatagagcggcggagtagccagatagacatgtccctgcttaatcagctccggcatgaagcggtacaaaaaggtcagcatcagcgtcgcaatatgtgcaccgtcgacatcggcatcggtcatgatgatgatcttgttgtagcggagcttgctgatatcaaaatcttcatgaataccggtaccgaacgcagtaatcatcgctttgatctcagcattgccataaatcttgtctaatcttgccttctccacattcaaaatcttaccgcggagcggcaggatcgcctgcgttgcacggcttctcgccgtctttgcggaaccgccggcggaatctccctctacaataaagatctcgcagttcttcgggtctttgtcggaacagtcggcaagcttgcccggaagagacattccctcgagggcggtctttcttctggtgagatcacgcgcttttctcgccgcttccctcgcgcgctgcgcgagcagtgatttttcacagatgttcttcgccaccgtaggattctgctccaggaagtaggtgagctgctcgctgacaaccgagtcaacggcgcctcgcgcctcgctgttgccgagcttctgcttcgtctgtccctcgaactgcggctcctcgatcttgatgctgatgatcgccgtgagtccctcgcggatatcgtctccggtgagcgccggctccgtatcctttaaaatcttattcgcacgcgcataggtattgaaagtcttcgtcaatgcattacggaaaccggcaagatgtgtaccgccttccggtgtgatgatattattgacaaagctgtaagtcgcatcattgtaggaatcgttgtgctgcatggcaacttccacatagactccgtccctggttccctcgcagtagatgacttccggatagagcgcttccttgctcttgttcaagtaggtcacaaattccttgataccgcctgcatagtggaattcgtgtgtatgcaccggatccactctggcgtcggagagcacaattcttaagccttttgttaaaaaggcggtctcgcgcagtctctgttttaacgtatcgtaatcatagacggtttcctcaaagatcgttggatccggatggaaggtaaccttcgttccgtgtttttcggcagaacacttaccgataaccttaacaggttcatccggcttgccaatcttataactctgactgtaaatctgtccatccttgtatacctcaacagaaagcttcgtggatagggcatttacaaccgatgctcctactccgtggagaccgccggataccttatatccgccgccgccaaactttccgccggcatgaagcaccgtgtatacaacctccagtgcagactttccggctttgtgattcatcccgaccgggataccgcgtccgtcatcctccaccgtgatggaattgtccggattgatcgtcacttcaatatttttacaatatccggcaagcgcctcatcaactgcattatctacaatctcatataccagatgatgaagtcctctcgcagatgtacttccaatgtacattccgggtctttttctgactgcctcaagtccctctaatatctggatttgatctgctccgtattcattttctgtacccattttattctccatttctgcatcagccataaaaacggctcacgcttactatattgatcgctcatatacatgaccggctatgacttcaaatacccggtttaccgtaaaacgatttctcacaaattcatccagtcccgtacaggtaatgatggtctgcgtatcggaaatattgttcagcagataattctgacggctgctgtcaagctcagataacacatcatccagcagcaacaccggcgtatcggaaatggacttcctcacaagttcaatctcggacaacttcagcgacaacgccgatgttctctgctgtccctgtgaaccgtactttcggatatcgacgtcaccgatcgagaacagcaggtcgtccctgtgcggtcccaccgatgtctgacaaagctttttgtccttttccttcgccctgctaagttcatcttcaaaaaagatatcgtcgatattcggctcatattttaaaaaaagctcttcctttccgccggaaatgcggtagtgaatgtcacttacaatctcccggagttcatccacgaactgttttctgcgtcggatgatcttcttcccggtctcaatgagctgcatgtcccagacaggcagcgtatcggaaagacttggccggtagatcatgtcttttagaagcttgttgcgctgcgctaagattttattgtaatttgtgaggtctgccagatagatccgatccagctggcacaattcggaatctaaaaatctgcgcctctccgccggaccattcttgataatattcagatcttccggtgaaaaaaacacaatatttaaaattccgaaaagctcactggcttttttgatcggaatcttgtcgatggcaatccccttggcgcggttcttcttcagatgcatatcgatctgatattctctcccaccgcgcacgacaaccgttttcagatgagcttcttcctcaccgaaacggatcatctccctgtcacggcttcctttgtgggacttggtcgttccgctcatatatgccgcttctaagatatttgtcttgccctgcgcattatccccgaataaaatattggttccttcatcaaaagaaatctctaaattttcgtaatttctgaaattcttaagctcgattgaccgaatgttcatctgactatctttactgtctcgccattataggaaacaagttcaccgccgtgcagcttttttcctctctgcgtctctacttccccgttcacagttacaagtccatcctggatcacgaacttggcatccacaccggactccacaagcccggcttttttcagtgcctgtcccagtttgatgaattcatcctctttgcgaatctctatttctatcatctttctcctacgcctcgtttctaaacggtgctggcattaaagttcaccggcagtatcagataaatgaactttccttcatcatccttgataaaacacggtgcctttggattcaccatataaaggcttacctcctcctcatcgatcacgcgaagcgcgtcaatgaagaacttcgggttgaatccgattaaaatatccttgccatcttttacaatatcaatatcctcattcatagaaccgatgaaggaattgatctttaactccatgtttccgtctgtcacattcatgatgatcggctttttgtcaccctctttgacgaggagcgtcgcacggtcgatacagtctaacagctcacgcttgttgatcttgacctttgtctcataatcggaggagagcatctgctcgatcttaaagtattcaccctcgatcagtctggaaacgacagtcgtatcatcaaattcaaatacaatgtggttgtcggtcaggaacatattgacatcttcctccgcgcttcccggaagaatcttgctcacttcctgcagcgtctttccaggaacgacaaccttcttgtgctcatagttattctttaactcgatgttgcggatggaaatacggtggccgtcgagagataccactttcaaatgattctcctcgatctcaaaaagctctcccgtcattaacttgttattgtcgttgtccgcgatcgagaagatcgtctggcgaatgacttcttttaaagtgaattgagataacgtgatggcttcatttctctcgatataaggaatataggaaaaatcatctccggattttcctacgatattgaactttgctttttcacaggtaatggtcgtcttaaaggaagcgtctgtctcaatcacaacatcactgtcaggaagctttctcacgatctcggaaaatatcttggcatccagagcaatcactccgcgttctgcgatctcaccttcgatcttcgtctcgattcccaattccatatcattggcagttaatttgatctcattggcagaagcatcaatcaggatacactccagaatggccatcgtggttctggttggaaccgctttcgatacgatattgacaccgtgcagtaaatttgatttggaacagatcagtttcatagttgttaataactccttcctgtggttcgtggaatatatggtgcgcacgccatacatgattgttataaaaagagattcaaagtaatattcttagggggtgtttatatgtgaataagtcacacagcccttgatctataagactttcaggtaaaaaatgaagggtgaaagtctgtgaattacgtgcggatgaaatctggacaacctgtgaataaaaaattatgtaaacttgaaagaaaaatgtgaaagaaaccttaagtggtttacataatgatatttatccagtttcatgaacaaaccttacacaatatttcaacaaccgaatgtgaatatctagttcgggttgatctttttcttgatggtgtcgatgagactgcgtgtcgtctcgtccgactcgtactcatccgaaatcttctggacgccgtggatgatggtagagtgatctctgccgccgagcagcgcaccgatggaatctaacggtgtgtcggtcatattcttacataaatacatggcaatctggcgcggccttgcgatgtctttgctccggttcttggagatcatctgatctaaggagatctggaaatgctccgatacgacctcgataataagctgaggcgtaatctccttcggcttatccggagtgatgatattctgaagctccttctgggcaatctccattgtaatgtccgttttctcaaggttggagtaggcgagcagtttattgagcgcaccttccagctcacggatgttggacttgatgttggttgcaatgtaattaaggatctcgtcgcttaagttcatttcatccgcttcgatctttttgcggagaatcgccattcgtgtctcgtagtccggtgttccgatgtcagccatcagaccccactcgaaacgggaacggatacgttcttccagtgtctccatctcttttggcggcttatcggatgtaagaataatctgtttgccggcggagtggagggcattgaacgtatggaaaaattcttcctgcgtactttccttacctataataaactgtacatcatcgatcatcagaacatcgatggtacggtatttttcacgaaacttgttcatcgcggctgcattaccgcttcggatggactcgatgacctcgttggtaaattcctcggaagtcacgcagataatcttcgcatccggattgcgctccaggatgaaatgaccgatggaatgcatcaggtgcgtcttgccgagtcccggtcctccataaatatagagaggattgtatgcctcgcccggagattccgcaactgcgagagaagcggagtgggcaaaacgattattgcttccgacaacgaatgtatcaaacgtataattggaattcagattcgatttggatgccgcttctgagtaaaaaggctttttctgtttattaggagaagaagcgatcgacttcgcctgttccggaagaatgaacttgatctcgtattctgttccggtgatctctgtgattgctactttgagaggcagatagtacttcttggaaatatagctgagtcccaactgctcggacgggacaaggatatatgcggtgttcccagtgacaccataaaattcaaggggacgtaagaatgtgttaaaagcaatgtcgctgatgtcgtgttctgtcttcacggtcatcaggatctcgtcccatttttctaaaatctgatccatgtaaacgctccaatttcttatcatactaaaaaaaatcctacaccctctatcctacaccattttagtgctttaatcaatgtttaatttgctttggagtgctatggcgtaggggaacactttaaaagaaaaaaaacgctatttgggcaaaatacggtgtctatgagggaaaaaaagtgatgtcatgttatagaccgccaaaaatcagcgtttgtgatgcttattcacaacttgtccgtgtattatccatgttttatccacaagttatccacatttcggggataacttatgtcaacggcgtatttaagggatttccgggatccttaattttacttttttttgtggaatggttgtggaaagcaattttacaagatatagttggcatgagtttcttccttatatatatagtggttatttttttccacaaagagcagattgtggaaatgtagatgaattctgccggccgggattattattttatgcttgacttggagactttttctgatataattgagaatgatgttttgtaacgtagaggaggtgaatgcgatatgaagatgacattccaaccaaaaaagagacagagagcgaaagttcacggtttcagaagcagaatgagcacagcaggcggaagaaaagtattggctgcaagaagattaaaaggtagaaagaaattgtcagcttaggccacatcttatgtggtcttttcttctataaaggacatgcatacagaatgaaatattccgagtcattgaagaaaaccaaagatttccagaacgtataccgcaggggaaagtcatatgcgaaccggtaccttgtgatgtacgttctttcaaatcagacagaaggaaatcgtttagggatttccgtgagtaaaaaagttggaaacagtgttatcagacatcatctgacccggctgatccgggaaagctacagactgcatgaagacatgttcaatagtggtttggacattgtagtcgtcgcaagaagcacagcgaaggacatctcgtatcatgaagtggagagtgcgctgctgcatcttgggggtcttcacaagatcattagtaaagaaaagaagatggaatcattttgaaaaaaattttgatcgctttgataaaattttatagaaaatatctttctccgatgaaaacgaccaagtgtccgtattgtccaacctgttcgttgtacgggctggaagctgtcgaaaaatacggagccatcaagggcggcacgctggctttatggagaattataagatgcaatcctttttcaaaaggtggatatgatccggttccatagtggaggtattttaagtgtcagaaatgttattaacagcgtatgacggtgcgattctcggaccaatcgcaaaattacttggatgggtaatgaatggagtctactatctgatggatcagattggaattggtaatgtaggtctttccatcattatatttacgattattatttatcttcttctgttcccgcttacttataagcagcagaagttctcaaagctgtcacagaagatgcagccggagctgaatgcgattaataaaaagtatcagggaaaaaaggatcaggcatccatgatggcaatgcagcaggagacacaggctgtctatgagaagtacggtgtttccatgatgggaagctgcgtacagatgctgattcagatgccgcttctgtttgctttgtatcgtgtattcatgaacgttcctgcctatgtaagcggtattaagaatttgttcacacagccgcttggcggcaatgcaacatccctggtagacggcatcatggcgacagagggatatcaggataccatgaccaatctggtgtctacacttaagatcacgacacagccggtagctaattttactgtttcggatccgaccgcgattgccaactcgatcgtggatgttacttataagatgaactccagcggatgggatgcgttaaaggatgcattcccggctctctccagtgagatttcatccacctatgagacggtgtcccatgtaaataatttctttggaatgaatatttcagatacaccgcttcatgtgattacatcaagtttttccgcaggtgcttaccttatggtaattgcagccttgctggttccgattatttcttatctgacgcaggtattgaacatcaagttaatgccgcaggcgactgcaagtggcaatgaccagagcgatgcgatggcacagcagatgaagatgatgaaccgtatgatgccgttattctcactggttatgtgttttaccgttccggtcggtcttggtatctactggattgccggtgctgttgtccgtgttgtacagcagtatttcctgaacaagcatttcgagaagatgaatcttgaagatattatcaagaagaatcaggaaaaggcgaagaaaaagcgcgagaagatgggaatcgccgagaaccagatttccaatgctgcaaaaatgaataccagacagatggtagatgcgaataagaagcagttgagcagtgcggagaaagagcttgagatcgagaaggcgaacgcagcgaagtcgaaggcaaaagccggaagcatgagcgcgaaagcaaatatggtacgtgagtttaacgagcgcaacaacagaaagtaagtttcggggtggagtaagttagaaagggtatggtgatgaaaatggattatattgagatttcagcaaagacagttgatgacgcaatcacagaagccatcatcaagctggggacaacccatgacaagatcgaatatgaagtaatcgaaaagggaagcgcaggtttccttggaatcaacagaaaggacgctgtgatccgcgcccgcaggaagaatgatacgaatgataatatccgtgatttccttgagagcgtatttaaggcaatgggacttaccgtcacgatccagatcgagaaggaagaggacagcaatgtcgtgaacgttgacttaaagggagacgatatgggtgttctgataggtaagagaggacagacgctggatgctcttcagtacctgaccaaccttgcagtgaacaagaattccgaggagtatgtgaaggtcaagatcgatacggaggattaccggaagagaagaagagagacgcttgagaatcttgctaagaacattgcttacaaggtgaagagaacgaagcgcccggtttctttagagccgatgaatccgtttgagagaagagtcattcattcgactttacagaatgataagtttgtgacaacgcacagtgagggtgaagagccttacagacatgtggttgttaccctgaagaaatagagtacaaaatgggggtgtcgtccgacatccccattctttcattaaaggagatttatgaaaacagatactattgctgcgattgcgactgccatggcaggatcgggaatcggaattgtcagaatcagcggggaagaagcggtttccattacagatcagatttttcatatgccgggcggtaagaagctttcggatatggagacacacacgattcattacggacatatccgggatggagaggaagtcattgatgaggtgatggttttactgatgcgcggaccgcggagttacaccagggaagatacggttgagattgactgccacggcggtgtttatgtgatgaagcgcattttggagacagtcatcaaatatggggcgcgtcctgcagagccgggagaattcacgaagcgtgcatttttgaacggacgtattgatttgtcccaggcggaatctgtgatggatgtgatttcggcgaagaatgaatttgccttaaagagttccatgaaacagttatccggcgctgtctcagatgcagtcaaagagattcggggagagattctccacgagatagcatttattgaatcggcgcttgatgatccggagcatatcagcctggatggttacggggagagactggagcttaccatagagggtgcagtggacagaattgagaagctgttggcttccagtgataacggccgcatcttaaaagagggaatttctaccgtcattgtgggaaaaccaaatgccggaaaatcgtcacttcttaacactctattgggcgaggagcgggcaatcgttacagaaattgccggtactacaagggatgtgcttgaagagcagattaacctgaatggaattgtgctcaatatcatagacactgcagggattcgtgatacggatgacattgtggaaaaaatcggagtcgacaaggcgcggaagtatgtgaaggatgcagatctgattctgtatgtagtagatgcctccacgaatctggatgagaacgacggggagatcatggagctgcttcacggaagacgcacgatcatacttttgaacaaatcggacttaacgccgttgacaacagcggaggatattcgtgcacatgtggataaagactgtccggttatttctatttcggcgagagagcagaagggaatcgatgtctttaccgagcagatccgggaaatgtttttccggggagaagttacctttaatgatgaagtctatattacgaatattcgtcataaaaccgctttacaggaggcactttctagtttacatttagtagagcagagtatcgcggatggaatgccggaggacttttactcgattgatctgatgaacgcgtatgaggtgctgggaactatcatcggggaagcggtggaagatgatctggtcaatgagatattcagtaagttttgtctgggaaaatagttggcctaaatatttaagaaaccattggacagctattattggaagtatgcaaccataggataaggaggaagcagcgatgattcgacatatctgtatgtttaagctgaaggatgaggataaggaagcaaatttgaaggaggcactgcgccgtttggaggagatgagagagattcctctgattgcaacgtttgaggttgtgacgaatgcggctgctgctccggacagcaattatgatctttcacttatttttgattttaagaatatggatgatctgaatgcatatcagaagcatccgatgcatgtggagtttggtaagtttattacagcaatcagagagagcagggcttgtattgattatgaattctaagaatcttttggaagaaacgtatgatgtggcagttgtgggagcgggacatgcgggatgcgaggcggcgcttgcctgtgcgagactgggacttgagacaattatttttactgtgagtgtagacagtatcgccttgatgccgtgtaatccgaatattggtggaagttccaaggggcatctggttcgtgagatcgatgcgcttggcggccagatgggtatcaatattgataagacgtttattcagtcgaaaatgctgaacaaatccaagggacctgcggttcattcattgcgggcacaggcggataaggcaaattacagcatggagatgcggaatacattacagaatacggagcatctgacgatccgccaggcggaggttgccgagattctcacaaaagagggcgatcgtgagcagattaccggtgtgaagacagtttcgggtgcaacgtatcactgtaaggcggttgtactgtgtacgggaacctatcttcgcgcacgttgtctgaccggcgagatgattacctataccggaccaaacggtttgatggctgcaaatcatctgaccgactcgttactggcacatggagtagaaatattccgctttaagaccggtactccggcaagaattgacaaacgttcgattgatttttccaagatggaagagcagaagggagacgaaaaagtcgttccgttttctttcgtgacgaatcccgaggatgtgcagatcgaccaggtgtcctgctggctgacttacacaaatgagaaaacgcatgagattatccgcaataatctggaccggtctccgatctatgcgggaatcatagagggaaccggaccgcgttactgtccgtccattgaggataaggtggtaaagtttgcggataaggacaggcatcagattttcattgagccggaaggacttcacacgaatgagatgtatgtcggaggaatgtcctcatcacttccggaggatgtgcagcatgagatgtaccgcaccctgccgggactggagcatgtgaaaattgtccggaatgcctatgcgatcgaatatgattgtattaatccgaaccagctgtatgcatcccttgaatttaagaagatccggggacttttttccggaggacagttcaacggcagcagcggttatgaggaggcagcctgtcagggactcattgccggtatcaatgcggcgatggagattctcggaagagagccgctggtgctggaccggtcggaggcttatatcggagttctgattgatgatctcgtgacgaaggagaatcatgaaccatatcgtatgatgacttcgcgtgcggaataccgtctgttgcttcgacaggataatgcggatctgcgtctcacgaaaaaaggatatgagattggtctgatctcaaaagagcggtacgactgggtctgtaaaaaagaacagatgatcaaagaggagattgaccgtgttgcgaaggttcatgtaggtgcgaacaaagaagtgcaggctcttctggagagttacgggagcataccgttaaataccggtgtgacgttaacagaactgatccgcagaccggagcttgattataataagctggcgccgattgatcacgagagaccggtgcttccggaagaagtgagagaacaggtcaatattctgattaagtatgacgggtatatttccaggcagatcaagcaggtggaaagctttaagaagctggagaagaaaaagataccggaaggattcgattatgatgaggttccgagtctgcgcattgaggcgcggcagaagttaaagctgtacagtccgacgtcaatcggtcaggcgtcgcgtatctccggtgtatcgccggcggatgtttctgtattgctggtgtacatggaacagatgaatcatcatggggaacatcattcataggagtatcattcataaaaagaaaaacagcgcagaaatggagatttgtgttttgcacaaacttgatatgcgcttaaaaacagtgcaggaatggagaggtggtttatggcgtataatcttgaaaagttcaaaaaaggcctggatgatttgcagatccatctggacgaaaaacagatgggacaatttctaacctattatgaacttctggtagaaacgaataaagttatgaacctgaccgctatcacagagtttgacgaagtaattgagaagcattttcttgacagcctttcgttgtgtcgtgtgaaggatttaagaagtatcgaagatcggccggagacatatcggattctggatcttgggacgggggcaggttttccgggaattcctttaaagattgcttttccgaaacttcagattgtattggcagattcactgaataagagaatccgtttcttacaggaggtcattgatacactcggattggaagatgtgactgctgttcatggaagagcagaggagatgggcagaaatacattatatcgggaacagtttgacctatgcgtgtcccgtgccgtggcaaatttatcctctctcagcgagtattgtcttccgtttgtgaagatgggaggagcatttatttcctataaatcaggagaggtggatgaggaagccgcacaggcaaagagagccatttatcttttgggcggtgaagtgaaggatatttacaaatttgatctgtttgatcagaagcgttcgtttgttgtgattgagaaagagcggaagacgccgaaagcttatccaagaaaagccggcacaccgacaaaagaaccgctgcagtaacaaaaaagagagataatgcgatggatccttgatccggtcgtgtcatctctcttttgattttatgaagtatttgattgtataaggtatgacgttacattagtgatcttcatgtaaaaacatccgcatgatgttcagaagcttatccggtacttcaagctgcggggttagacctgcatttgaaatataggcggtttcgacagccgcgtttttgtgtgcataagaatctgcaatggcaactgcatctgtcatggaacggctttcaataatatacagtggaacggtaagctttttcacggcatgtccgattgcattgtcggtgtaatgtccctcgatgcttgccatcagatattttccgtggctctttcccatgtgcgatgcctcatagtaggcatcgagcattttactggatacgagctgcggtctgctgaagtatgttttctgcagtgtccgtcggatattggattcgtgtgtccggacattgtagaggaatgttcctatgatcggcagctccagcagtgtctttttgacagaggaatacttgtccggtgtgcggtcaaagctgctcatcgcaggcggattgatcgcagtgatgcttgcgagaagattcggattcatattctgggcaagtaccgcaaacgaaatagaattgcctgttgtcacgacatccgggcgttccccgatcacatcatgaataaaatctgtgagaagctgtacatacaggtaattggtataagtcagataaggcttgtccgagcggccgcatcccaacagatctatggtatatactgtatagtgcttctcaagctttttcacaagtctgcaccactcataagaagaagagatcggatttaattcgtgaatgagaaggagcggagaaccggaaccgcgcttggtataaaaaatactgccgttcttccagtgatagtagctgccgctttccgtctttaaaatatttttcatctctgctgtcatatcgatgaagcggttcacaagatgaatcgtgcctgcagcaagagcagtcagcagaaagaaatgtctgatattctttttcatgctattgttcatagaacctcccgtaatctttgcaaaacgtttcctattacttatattatagccgctttccataacttatacaaattaaaaattctgaaaatataaatttttgcttttcattgaattacgtttggtataaaataatactggtaatttggtttttaatatcaaacatatgttcggtggcaaaatggtagaagaatatattcagaaaatttatgaggaacttttaaaagaggagcagaacagtgcgaagcggatttctgatttacagattcatttgaaagagacgcaggcaatgatccatttgcttgaggagacgaatgatcctaattatgagtcgtttactccaagaaaagtaaattccaggaataagcagaaaatcgatgaattgcatgcagagatgaaagaactcgaggaagcaattcagcaggagacagactaccatacgcagcagatggaaagagtggaagaagcggcgaaggtattgcggcaggcggaagcagatgttgcatacaggtgtgacagaaatacacttgaggaagaaaggtatcatacgtctctccttgaaacgcaggagaatgagagacagcgtatttcacgcgaacttcatgacagtaccgttcagaatcttacggcaatggttcacatggcagaactgtgcagtaaactggtggatatggatccgatccggtgtaagctggaactcagtaagatgatcaagaatctcagggagatcatcgatgataccagaaagatgatttataacctgcgccctatgtcttttgatgatattggtctggatattacaatcgagagaactttggacaagctggaagcaaccggcacgaagaagattcattttgtagtggaaggaactccttatcaattaaaaccgattatcgggataacgttacttagaattattcaggaggcatgcagcaatgcgatctgtcatgcaaacccgactctgatacatgttctgttaagatatgagcaaggggctatcacggtaatagtcgaggatgatggaacaggatttgatgttcatattctggatgatcgtccaagggatgataattctgggtttggaatgtctatgatgaaagaacgagtatatttattatccggttcgatacagattgactctaagatcggtgttggaacaaaaattatagtgaaagtacctattagtaacaaggaggagttttaaatggcagtaaaagtaatgattacagatgatcattcattgattcgtgaaggattaaagcagctgttggaactggaaggagactttcaggtaattgcagaggcgtgtgatggtattgagtgcatggaaaaattaaaagatcagataccggatgttttgttgctggatatcaatatgccgcgcatgaatggacttgaagttttgcagaagattaaagatgaaaaaatagatgtcaagattcttgttcttaccgtacataatgaagtagagtatttattgaaagcagtggacatcggaatcaatggttatctgttgaaagactccgagtcttctgaattgaaaaaagcaatcttatctgttgttgatggagaagattacatacagccgagtctgattcctgtattgaatgcaaaaatgattgaccgggatatggacagtgagaagattgaaaaactgacgaagagagaactcgaagtgttgaaacttcttgcggttggaatgtacaataagggagtagctgatgaattgcacatcagtgaacgtactgtgaagaatcatgtatcaagtatttttaaaaagattgatgtttctgatcgtacgcaggcagcggtatttgctattcggaataatttgatttctattcattagtattagagagtataaagattgagtgtttcggaatcatccggtacactcaattattttatagaaaataatgtttattactacataaaaatattttaaaacgcgtattattggacaaatcatcacaatgtttcacgtgaaacattatataaatgaaatgtttcacacatgttttctacaagattttgtatttataaaaaaacagaaatacaacagtttgaaatcactgtgaaaatgtttcacgtgaaacatttcatacgaactttcctatagaaaagaatatgtaaaagtgttataatgaactctgtcgagttcatattagaagtttcaatgaaacttcggatgcgcaaaagaagcgcaaacagaagagataatgaactctggcaaacaaaacgcaccaaatgaacagggtaataaaaatttaaaagaggtaatatatgagcagaataattgcaatcgcaaaccaaaaaggtggtgttggtaagacaaccacagctatcaatttatcatcctgtcttgcagaagcaggaaagaaagtgttgaccattgatcttgacccgcagggaaatatgacaagcggattaggcgttgataaaaacgaactggaaaatactgtatatgaattgatgctggatgagtgttccatcaaagagagtatggcagataccgtagtagaaggaatgaagattatcccgtccaatgtgaatcttgccggagcagagatcgagttacttggtatcaatgaaaaggaatatattttaaaaaatgccgtagattatatcagggatgattatgattttatcatcattgactgtccgccatccttaaatatgctgacgatcaatgcgatgacaacagcggattctgtgctggttccgattcagtgtgagtattacgcacttgagggattgagccagctgatccacacgattgatctggtacagcagagactgaatccagatctcgtcatcgacggagttgtcttcacgatgtatgatgtgcgaaccaatctgtccaatcaggtagtagagaatgtaaaagaaaatcttgataccaagatctatgagacactgattccgagaaatatccgattagcagaggctccatctcacggacttccgatcaatatgtatgattcaaaatcagcgggaacagaaagttatcgtatgttggcaaaagaagtgatggagagataaggaggaaaactatggctgctgcaaaaaaaggtggactgggaaagggaattgattctttaattccaaacaaagtaagtgccacaaaaacggaagcaaagaatgaaaatgtgaaaaacgataaagtcatcgagggtgttctggtaaatatcaataaggtagaaccgaatcgggaacagccaagaaagaattttgatgaggatgccctgttggaattgtccgagtcaatcaaacagtttggtgtgttacagcctctgcttgtacaggacagaaaaggatattatgaaattattgccggcgagcgcagatggcgtgcagcaaagcttgccggattaaaagaggttccagtaattatcaagaatctttccaaccaggaagtcgtagaaatctccctgattgaaaatatccagagagaaaacttaaatccgattgaggaagcaattgcatacaagcggttactgacagagttcaatctgaaacaggatgaagttgccgagcgtgtatcgaagagcagaaccgctgtcaccaattccatgcgactgttaaaactcgacgagagagtacagcagatggtaattgatgacatgatctcgaccggacatgcgagagcacttctcggtattgacgatcaggaaaaacagtatacgacagcacagaagattttcgacgaaaaactgagtgtgcgtgagacggaaaaactggtaaagaagatccagcaggaaaaagatcagccggaagcaaaggaagaggtaaagatcgatccgaagatggaagcaatctgccgtgatctggaagagaagatgaaagtcattcttggaacaaaggttgccatcaatcagaaggataaccagaagggcaggatcgaaattgaatattattctatggatgaacttgaccgtatcatggatctgtttggatccatccgaaaatagacagagtaagattctgataaaagtcatatcagaataaagagagaggaagcatatgatttcacagtatttaggttttgattccgattatattattatcggacttagcgcagtggttctgattctattgattcttatcattgtaaatatagcgcagatgcggaagctgaaaaaagcatacaaagtatttatgagcggaaaaaacggtaagaatctggaagataccctgatcaagcgtctggatcaggtagatacacttcttgaggcaaacaatgagaatgaaaaaacaatcaaatcattgtttgaggccatgcagctgacctatcagaagatgggactgataaagtatgatgcgttcaacgagatgggaggaaaactcagtttttctcttgccatgctggatgtaaggaataacggatttatcatcaatgccatgcacacacgcgaaggctgctatacatatatcaaagagatcgtagatggtaattccattatcgtgttatcggatgaggagcagaaagctctcgacagagctatgggaaaaacagaaaacaacgaatgaggataatgtatgagaatacaactggtaagaacactgcaagggggggagaaacttgcagggccggtcataacgaaggaaaatgaaattctcatttctgagggaacaacgctgaaaacggaatatctggatctgatctcctttctgggaatcgagaccgtgtgtatcgaagatccctatgaggaagatgaaacaccacatgatattatcagtaacgaaaaacgggaagaatatattgaaaaaataaaatctattctggaaaagcatatttatcacaggggcagttctcttcgggaaattgaatacgtcgcagaggacattattcaggatgtcatgcaggcggatgaaaatatggtaattgatcttttggaacgcgaaagtaatttgtacgaacatacacttgtagtaacaaaattatgtattatagtcgcaaaaaaaatgaagctcactgcggagcagatttacagacttgcactgggagcattgctgcatgatctgggactccgctacattacggtgccgtatatcaactgcgacatcaacgaattgtcagaagcagaggcttttgaataccggaagcatccgatccttgcgtactctgttctggaggaagaaaaatggatggatccttttgtaaaaaaaatggtacttgtacatcatgagagaagagacggctccggatttcctctgaagcagaaaacgcgggatacggaatgtggaatattacaggcatgtgatgcatttgactgttttatcagcgggatggaatgcagacgtatgagcatccagcaggcactcgagtatctggtggaaggtacggatattttttatgacaggagaatcgtgcgtgtgatcgagcggctcgtcgcacgctatccggtcgggacgagagtccggctcaataccggagagtccggcatcgttttaaaacagacagaaaattccatccggcctgtaattagaattttggatgaagaggaccggttgacggaaaagatataccagttgaataagaacaagaatgtatctattcttcaggtcgaaaactagaaacagaaagaggtgaagatagaaaatgcacaaatttctaagagccatcgggttcagtcatattacaaaagaacagctgcagcatatttttgcagatattataagcgcaccgacggttcagaaggcagcacttgattcggagggcaatgaatttgcagaactgtcaaaggagtacggagattttttcggaatctctgtccggggcgtgtataacgaagatgatacctttgagatggaatattactatccgtatttgtgtggaaagaacatatccacaatagaacccgcagaagtggaaaaacatgcggaaaaagaatcctatgcggggatatgtgatgaagtccgcattggagtgacactcattttttatcttcagaatgtggtggattatcttgcggtcagcaagagcaaaggatatatgaatctggcagacggcgtcattttagctgcgctgtctacggagggaaagattttattcccgatcaataaggcggagaaaaaagtgcctcatgcgccaaaggagggaacagaccggaatcatctgattgccgcggcaagagacggggatgaggatgcgatcgagaatctgacgctggaggacattgatacctactcactgttgtcaaaaaggatcacacatgaagatgtgcttagcattgtggatacctactttatgccgtacggtattgagagtgatcagtattcggtgctcggcgagatcatggatgtgacactgctccagaaccgtttcacggaggaaaatgtatattccatggaaatcatgtgcaatgatattcttttcagcgtctgtatcaatcaaaaagatctgctcggcgaaccggaagtgggcagacgttttaagggaaatatctggatgcagggcagcgtaaaataccgggattagtttgtgattttcctatggtcttttgacggataatatgataaaatgaataagctgtatacagagaagcctgtatacagcaaatatatgtttccttagttaaatggatataacagccccctcctaaggggcaactaagtgcagaccatttagtgagacacaacgggattttagagtttgcaaaaaggctaaaatcaatatataatagcagggacaattcatcacgaaagtgattggattcataaacatggcagccggagccaaaaaggctgaaaagcccgaaaatacggcatttgttcccttagttaaatggatataacggggtcctcctaagactctattgtaggttcgattcctatagggaacgctctattttaagcggtaatgagagaaaaatcattgccgtttttttgttgtttttctgctaacagcaaatcaaaaaatgagcatttttgctaacagaaaatgcaaattgctaacagtaaaattattgtagatttgctaacaggaatgaaaagctataatgcaactggtgtaaaaggttgtaaattcttgtagctaacaaaagggtaatgattaaaactatttctgcttggaaaatatcaagcctgaatgagtattccgttcagattagattaggttctaatctgggcggatttttttatttcaggaagaaggaggatgcctatggcagaaaaagtggatcagatggatccagatgaaaaaatcgttgagatagcgattgaacggttaagagtattggcattgaaactgagaaattatatgaaaattgctcatccgggaactttcatttccaaaccagtaaactaagtaaaataaaaattctgctttacaaataacagataaagtattaaaataaacaaaaagatatcttcagggcagggtgagattccctaccggcggtaaagcccgcgagccgagaggcatgatccggtgagattccggggccgacagtacagtctggatggaagaagatgatagtacagttgattttttgtatgaatgaatgtagtatcagagctctgagatggtgatccatttcagagctttttatataggaaaatcagacattcatttatcaatcatatgtaacagatcaattccaccctgcagatatttctgcaggctttttttgtatctggtacatcgttttcgaaataactataccattcacttgtctgtgaatccgattgcacatgtttaaaagcctcggcgtagcccaggcaaagaacaggaataagaaagaaggaatagaaatgacggatcaggaatatatgcttcgggctattcaactggccaaaaaaggagaaggctggacgaatcccaatcctatggtaggggcagtgatcgtaaaagacggaaagatcatcggggaaggctatcataaaaagtatggagaacttcacgcggaacgtaatgcaattgcttctcttacagaatcagcagaaggtgcggtgatttatgtcacgttggagccttgctgtcatcatggtaaaacacctccatgtacggaagcgatcattgaacagaagatcagaaaagtggtgatcggttccagagatccgaatccgaaagtggcaggaaaaggtgtacagatgttaagggaagccggtgtaacagtagttgaagattttatgagagaagaatgtgatcagctgaacccggtgtttttccattatattactacgaagactccttatgtggtaatgaagtatgccatgacactggatgggaagatcgcaacgaaaacaggagcatcaaaatggatcaccggagaatctgcacgaaaagaagtacagcatatgcgacatcagtacatgggaatcatggctggtattggaactgtgcttgcagatgatccgatgttaaacgtccgggtagaaggctggaaaagtcctgtcaggattgtgtgtgacagtaagctcaggatcccgccgggcagtcagattgtaaaaagtgcggaaaagtaccggacgatcgtggcttatgcagaacagaaaaatgcagaagagaaaataaaaatattacataccatgggagttgaaaccatttactgtcccgacgaaaagaatcagatagaccttaagaagctgatggcagatcttggaaacagaggcattgacagcatcctcctggagggaggaggtacgttaaatgacagtgcactgcgagctggaattgtaaaggaagtacaggcttttgtggcaccaaagctgtttggcggtgtggctgggaagacaccggtagagggtattggagttgaactgccgtctgaagcagtggaactgaaatatacagatatctgccagatcggtgaggatatccggataaaatgtcaggtgtgtgataaaaaacaggaggaatcatgtttacaggaatcgtagaagagaaaggaaaagtccgttatatacagctgacaggggaatcagggatcctggcagtgaaagcccggaaagtcctggaagggacaaggatcggtgacagtatcgctgtgaatggtgtgtgtctgacagttacgtcgattcagccggacggatttactgccgatgtgatggcagagacgatcagaagaagcagtcttggcagctgcaaggccggaagccaggtaaacctggaacgtgcaatggctgcagacggcaggttcgggggacacatagtaagcggccatattgatgggactggcgtgatacgttccatgctccaggaagaaaatgccatctgggtatcaattgagacatcgccacagattttgcatctgatcgtggaaaaaggatccgtctgtattgatgggatcagcctgacagttgcaagggttgatgaagctggttttcaggtgtcggtcattccacatacaggagaagaaaccactcttttggaaaaggtgccgggggatctggttaatctggaaaatgatgtgatcggaaaatacgtagaaaaactgcttggcatcagaaaaaacgaagaagagaaaaaagaatccggaattacgatggagtttcttgaagaattcgggttttagaacaggaggatatacactatgtcacaaaattatcagtacaacacaattgaagaagcacttagggatcttaaggaaggaaaaatagttctggtcacagatgatccggacagagaaaatgagggagatctgatatgtgcggcagagtttgcgaccagggaaaatattaatttcatggcgacctatgcaaagggtcttatctgtacaccgatgagtgcagaaattgcggcgagattgaactttccgccgatggttgcggagaacacggacaatcacagtacagcatttaccgtggcagtagatcacgcagatacaaccacaggtatctctgcggaagagcgctcctatactatcatgaagtgtgtggatgatcagtcaaaaccggaggatttcagaagaccgggacatgtgtttccgcttatttccagaaaaggcggggttttggtacgaaatggccatacagaggcaacaacagatcttatgagacttgctggactgaaagaatgcggcgtgtgctgtgaagttatgaaagaagatggaactatgatgcgtacatcacagctatgggaaatggcaaaagagcataaccttacatttattacgatccgtgatctgcaggattatttaagaatacatgaaaagcatgtaaaggaggaagccgttgcaaacctcccaacgcagtacggtgattttaaaatgtatggttatatcaatgatattacaggagagcatcatctggcactggtaaaaggtgatctgggagatggtgaggatgtgctttgccgggtacattcggagtgtctgacaggggatgcattcggatcgctcagatgtgactgtggcctgcagctgcagacagcgatgcgccaggtagaagcagaaggccgaggaatcattctgtatatgagacaagaaggccgaggaatcggactgatcaataagatcaaagcatatgcgcttcaggagcagggatacgatactgtggaggctaatgtgaagttagggtttgcaccggatctcagagagtactgggtcggggcacagatactgtcagaccttggtgtgaaatcattaagattactgacaaataatccggataaagtctatggacttggcgaattcggactgaagatcaatgagagagtacctctggagattccggcacaaaagtatgaccggaagtatatgaagacgaagcaggaaaagatgggtcatatttttaaagaaataaatttataaaaaacagcaaatatcaggaggaagaaaaaatgagacagatcaatttagtagaaggaaaagtagtagcaccggagggaatgaaggttggtatcgtggcagcgagattcaatgaaattattgtgaataaattattgggaggggcagtcgacggactggtaagacatggagtagaagaagagaacattactgcagcatgggtaccgggagcatttgagattccgattacagcacagaagatggcacagtcaggaaaatatgatgcaattatctgcgttggagctgtcatccgtggagatacttcacattatgatctggtgtgtaatgaatctgccaagggaatcgcacaggttgaacttgcaacaggaatcccggttttattcggagtgatcacgactgaaaatatcgagcaggctattgcgcgtgcaggaagcaaagcgggaaataaaggctatgattgtgcattatctgcgattgagatggtcaatctgatgaagcagctctaaaagacaggaaaataaatgatgacaaaaacaatcatattcgattatgatggaacgatccatcatacccttggaatctatgaaccggcatttcgtgaaacctatcagtggctgacagaacagaaggttaccgaagaacgggagataggctcggtggaaattgccggctggctgggacttaacagtaaggagatgtggaatacatttttgccggaactggatcagagctataaagagcaggcaagcacgatggtaggagatctgatgataagacagatcaggaaacataaggcagtgtggtatccgggagcagaggagatgctaacagctttgaagaaccggggatatcaccttgtgatcttaagtaactgtaaagcttcatatcgtgaggcacactggaaggaatttgggatggaacgatggtttgaccgtttttatgactgtgaatcatacagattccgtccaaagacagaaattgtgcaggaaatcatccgggaatatagtggcccttatctggtagtcggagacaggagacaggatctggaatgtgccaggtcctgcaaaagcccttttataggatgcctgtatggatatggtgagaaaggggaactgaatggggctgattattatgcagaacatatagaggatatactgcagatggtgatatgatttttgcaatataaaaatctgaaggaaaaaagttaaaaataagtacttctgtaaaataaaaggatatagaaaatttgcaacaacttgttgcaaattctgaggaggggatgattttaggatagtcatagtgatagaggtaatccactttcctaaccccatctgtacagtaaagttctcaagtccagttgtacaaagcgctactgcacggggaaccagatggaatgcatctccacttcctaaaagaactgccataattccaaacatggtaaactgtcggtttcctttgcctttgcggatcatttatagattttattgtggaagattttgcataaagtgttttccgtgcttgtgtgtaccattatctgatatcaaagcagtacagggtgattccggccatgcacaggtcaatatggttacggatgcgtactctcatatttcggatgatgaccaaaggaaaaatgcagagctttttaaagaagcattttatgagaaaaagaatctgaatccagagaggcgggcgttgctcaattcgttggcgaaaacgatgaagtaatgaaaaatagtgaaaaaatagtgtaattttaatgaaaaaacaatccataaaacgatataatatatggatgaaatgaggatatttattgtgtatatggatattctatctccatcaaatctattgagatctccatcatttgatgatagaatgatggagataaatctgaaatgaaggagattcatatgagagactttgattttattgtaagtcctgcgaagttgttaacacctgaaattgttcagatggttagcagcatccatgaacataaaggcaaacaggaattatttctcgaagccaatgtagatgaattgaaaacacttttagaagttgcattgattcagagtacgggagcatccaaccgaatcgaaggtatatttacaagcgataagcgtttggaagaattggtaagtcaaaaagcagaaccccgcaaccgatctgagcaggaaattgctggttatcgtgaagtactttccacaattcacgaaggctatgaatatatcaacccaagaccgaacattattttgcagttacatcgagatctgtactcctattcacaggggggtgctggtggaagttataagaattccgataatgtaattgcagaaacagatgccgagggtcatcagaaggcacgttttattccagttcccgcatttcagactgctgaagcgatggaagaactttgcgcccgcttccttgaagcatgggaagctgaccgcattgataaactggttttgattcccatgttcattctggactttctgtgcatccatcctttcaatgacggaaatggtaggatgagccgtttgctcactttactgcttttttataaggcgggatacatcgttgggaaatatgtcagtatggaaatgctgattgaaaagacaaaagaaacatattatgaagcccttcaagcaagttctactggctggcatgagggagaaaacagctatgagccttttgttaaatattatctgggtatcatgttgaaagcatacaatgaattcgaaagccgtgtagagcatttgaagcatcggagtctttctaagcctgatagaattaaagcggttattgataacaaggttggcaaaattacaaagaaagaaatcatggagctttgtcctgatataagcaaaattaccgtggaaaggactttgacgaatctggttaagagtgggtatatcgcaaaagttggtgcaggtccatctactggttatgtccgtgtttaaaaatatgaaagcagcttataaatttgctagtcaaaaacgcatggacaaaccgtctcgtatgcgttatattatttatagacaagaaaatatcttgtacttacgataggaaagtttaattgaatactgtttaccatgatcgaacgtacgaagcatggtggtcatataacagatgtcgatggtaatatcaaggcattccccgattattagctggagcaaacaatcagctaactttcagagctttacagagcttgacagagggggtattcagaataactcaaattgaatcggaaacagttttatatagtgtcccacttgggtttaccttacctcagattgacagagagtgacaataggttggggtcctcctaagactctattgtaggttcgattcctatagggaacgctctattttaagcggtaatgaagatagtttcattgccgcttttttcgtgcagaattgcaatttcagtgacaggtttgtcagtgaaacagggttgaaaatactgattttgtcagcagggatggatgctgattatgtggacgatgacgaggactatgggtacgatccagaggttgaggactatgatgcagatagctccgtcgatgaagatgataatgaacctgtgtaaacaggataggcttaatgtctggggcaaccttcaggttgcctttacatagtctccactttcaaaaaataaaatattttgtgtttttgaaagcgatctcttgcatatactattagcagacagtataataagtacatcgaagcagtttcaagaaatgaaaaatttttgacttttgaaagcgggtgacgatatgaaaacaattacaagagcaaaatatctcgatagaatcattgaactgaatggtactcctgacatcaagatcatcacgggcattcgtcgatctggtaagtccaagctgatgcaggcgtatattgagtatctgaaaagccattttgaaaatatcaatatcatcttcattgacttcatggatttggcgtatgaagaaatcaaggaataccatgccttacacgcctatgtggaagaacattatcaggaaggtaaaacgaactacctgtttgtagacgaggttcagatgtgtcccaagtttgagttggcaatcaatagcctgtactctaaggaaaaatatgacatctatgtaacaggctccaatgctttcctgttgagtgcagatctggcaaccctgtttaccggacgctatattgaaattcatgtgtttcctttcagcttccaggaatattgccaatattataatgatgttaatgataaagataagctctttgatgattacgctatcaagggcggtttagcaggttcttacgcttacagaatcgaaaaagacagaacaaactatatcaaagaggtctacgaaacgattgttacaagggatttggtgcagaaatatgcgctcccggacactttggttttacaacgtctgagcgagttccttatggataatatcagcaacctgacttctccgaataaggtcagtcagctgctgacagcaaatgagaccccaaccaatcatgtaaccgttggtaagtacattaagcatttgtgcaatgcttttgtattttatgatattaagagatacgacatccgaggtaagaaatatcttgaaagctctgaaaagttctatttgtgtgacagcggtattcgatatgcaatactgggaagcagaaatatggattatggcagagtatatgaaaacatcgtttgcatcgaacttcttcgccgtggatacgatgtctatgtcggcaagctctatcaaaaggagatcgactttgttgctcagagaggcagcgagaagatttatattcaggtcagcgacaacatttccgggcaggaaacatttgagagagaatgctctcctctgcttcagattcgggatgcttatccgaaaatgattattgccagaaccagacatccccaatatagctatgaaggagtcgaaattcacgatatagccgattggctgctacaagaataagcagggcgaaatatctccgtctacagagtaaaatagatagttactttttctgcagcctgtgataaacttgttcatgagcgggagaaagattttggactgcacccccaatatcgtcataaaagcaggggaaatgccccggaattatttaataataggtaataaaaatgacagaagagaaatatacgatccataagtataaaagaattttattttatgtggtgatacttgtgctgtttgcagcattttttttagggcaaagcatttaccccagtgagagggaaacggtcacggaggaaagcattacttataccggaaccttttaccgggagctgccagacggaacagaagaggagatccgggttccggaccggtatgatgtgcctgccggtgagcttttagtcatccggtcagtgctcccacaggactataatgaaaatacgatcgccatcagatcctctctggagaatgtgcgcgtttatatcggaggggaactgaggacggtgtatgatacgaagaataccagacccttcgggaaaaattctgccagcgggtatgtgttctgcgagacgtccggtgaggatgcggggcaggaagtgcggattgaactgcagtcttttactgaaaagtattccggtgtcgtcaacacggtatattgcggggataaattagatatctggggctatatatttcactgctattttatggtaactctgatcgcctgcactatgctgttttccggactggtcgtgctgatcatcagtctggtgctcgatattgtatacaagacaagatttgatctggaatatctgggatggtgcatgatcctgggagcagtgtggatgctgggagaatcgaagctgcgtcagctgtttgttcccaatgcttctattctgtcgaatatgtgcttctttgttgtgatgatctgcccggtcccaatcatgttctatattgatagtgtgcagcagggaagataccggaaggtctatcatgtggcagaatgtatcatttgtgtgaattttgtgatatgcacggtcttacaggtactgaatatcgcagattttatttcgacaatgttcttgtcccacatagtgatcgcaggaacgttcctgacgatatttatcaccatctgccgagatcttatcaagggaacagcgaaacattacaagcttccgctgattggactggtagctgccatgatcgcagtcatgctggaggtgacagaggtgtatcgtgttgtgtctatgtccggaatctttatcgcaatcggactggtggtcctgctggtcgttaccctgatccagacaatggaccgcatccgcgagctggagctggcacgacagaaagaggcccgggaaagcctggattacctgacaggacttcccatgcgtcataaaggtgagacactgattattgaaaaaatgcaggagcatgatggctgtctgggatttgtggatatggataatctcaagaagatcaatgatgtctatggacataaggcaggggatcatgctctcaggctggtaggagcaatgctcacagcgtgcatggagaatgcggtggtctgccggctgggaggagatgagtttctcttctatctgtctgaggtatcagaagttgagatgaacacgcagatgagaaagctgtttgacagctttgaagcggcaaaaaatgccacgacggagacttcaccggcattcttatcctgcggtctgtgcatgtgcagacagggagaaagctttgaagaatactatataagagcggacaaggcattgtattatgtcaaacagaacggcaagaacaattaccggttttatgaggagctggcggaacagtaagcatcgatattccatgccattttagaatacctgatgccggccgatgtattgacgctggaataaatcgtggcagaaatcccagataaaagcaggaatttaggagaaataagataatgtcaaaagatgaatacctgatcacagatgccccgctcaaagcgttgactgtttttgcaatgcctatgattctgggcagctttttccaacaggtttataatatggcggattccattattgtcggccagtatgttggttcgtctgcacttgcggctgtcggtgcatgcgcggcacttacgaatgtgtttatttgtgtggcacttggtgccggtgtcggtgcaggcgtactggtgagccgctattttggtgccagagattacggcaaaatgaaaacgattgtgtcgacatctttgatcagctttctgatcctaagcatacttcttggtgtattcggctttcgtttttcccatccgatgatgagccttttacaaacgcccactgacatactggaggaagctgtactgtatctgcgggtatattttgtgggatttccgtttttatttatgtacaatatcctttcgacgatgttcacctcaatcggggaatcaaagattccgttgggtctgctgatattttcttctgttttgaatattattatggatctttggatggtggcaggacttggattgggtgtatttggtgcagcccttgcaactttgatcgcacagggcatttctgcggtattttcattcgtgatctttttttaccggatgcgccaatataagagtccatttcactggtttgacggacaggagttacattatatgctccggattgccataccgtcagttctccagcagtccacagtatcaataggcatgatgatcgtgcaggcagttgtaaacccatttggtacacaggcactcgcaggttattcggcaacaatgagagtagagaatgttttctcactgatatttgtgtccattggcaatgcagtttcgccgtatgtgtcccagaatcttggtgctcagaaaatcgggcgtattaaaaaaggttatcacgctgcactggtgttagatctgtgctttgcagttctggcttttataattattgaaacactgcacacccagatttcttccttatttctgggaaaagacggaactgctttcgcatatcaggtatccggggattacatgagatggcttggctatttctttattttcatgggtattaaaatggcaacggatggagttttgcgtggacttggaatcatgcgtccatttcttatagctaatatggtaaaccttgcgatccgtctgtcggttgctttgatttttgcaccgcgctttggtattgcatttgtctggcttgccgtaccggcgggctggttggcaaacttcctgatttcctatgcggcgcttagaaaatcgtggccggatgatagaatcgctgcatcctgcaacggttgtatggattctgcagaaacgaagaagtagctgcagctgccaatggaactgcacggattgactgcaacaaaaacttccagagaggcgaggaggaagcaggagctgctgcggttgaatccatatcggaaaatatctatagtcgaaaagcaaaaaggcggaagtctctgtgggaggcttccacctttttatctacagcaagaagaatgagttttctaatcgatctttaaaatcagatcaagtacgcgcttggcacagcgctccagatcgcttcgatcgagagcaccgagttccatcgcctttttcacgcgttccgggaaaccgcacgccattttcacatcatttccggctttgatctctttgtaatgttctcctctcgtccaccagtcggaggttaccattccgtgaaaatgccactcgtcacgcaggatgccttcgagcagatcgtgattttccgaagcgcggtggccgttgatcatattgtaagcggacatgatgacccacggatcggcttccttcacgatgatttcaaatgcctttaagtagatctcgcggagtgcgcgctcggagacgcgggagtcgctgtgcttgcggttggtctccttgttgttgcatgcaaaatgcttcacggctgcgccgatgtgctgcgactgaatgccgcgcaccatggctgcgcccattttgccggtgagcagcggatcttccgaatagtattcaaaatttcttccgcagagaggattgcggtgaatgttgaccgccggtgtcagccatacggcgatgttgttctcttttacttcctctgcgcctgcggttccgacctgctcaaccagggcaggattccaggtggaggcgagcagtgtggcgcatggccatgccgttgtgcagacctcacactgcggggtgatgcgcagaccggcaggaccgtcggcggtcatgatgtttggaacgccgtattccggaagattgccgtagccgtaggtattcgcgacagaggtattcggctgaccgccgagcagatgaattaggtcatcattatcgagctgggcggtaaattcatccagggaaatctttccctcgtaaacgtcgatcagcggatgcgcgttttccttatagaaattcagcagaaggtaggagccgcgtccgcgtgttgccggggcgagagcctcctcggtgcccggtaccattttttcaaaaacacaggcattcggatcgttggcagttccctgcggaagctcttcgtagcttccgtctgcgagcagacgcttcttcaagcttgtaggtgcggctttggaggaaagctgttctaccagcaggttggcgttaagcgtcatgacataatccagcgcaatgacatcccggacggaagttccgatgtaaaaatgatagtctcccttttccagtatgtaggaggatttgaaaatttttcccagatcatcgtaggaagccatggaatcctttgctgtctcgagcgtcagaagctggctttcgcccgggaggagcgttcttgtcttgcaaaaagcggagagttcgcgcgccggtttctgcaaaagtccctgcggcgcactgtaatacatctgcacgacttcttttccgctgtaatctccggtatttgtgacaaggacaaaagcgcgaatggcctgctcggtttcggtcacactctgcaccacaagggagaactgtgtgtaggaaagtccgaatccgaacgggtagcatacgcgttttgccgcatccccaaaagtctcaaaatagcggtaacccacatagatatcctcggtatagtccacgtagtcaaccgattcgtggaaattcgcggtggaaggatagtcgttcacggaagcggcgaaggtgtccggaagcttgccggacggggatacctttccacacagcagttccgccatggcaagtccgccctccatgccgccctgccatgcgatgagcgcggaggagatctgatcgtcatttttgatccaggaggtatcgatgatgccgccgatattcaggacgactgcaattctggaaaaatgctgctttacctgcgcgatcatggcggattcttcctttgtgagatagaagtcgccgtccgggaagatctctccggagattttcggcatgctggtctctgtctcccacggattgtattccccgttgtattcgatgctggagcggtcccagccttctccggaaaaacggctcaatacgatcacagccgtgtcggtataggcgctggcgccggcgagaagctcggcggagagcgccggctctgtcgtcatgccgggaacggaaccctgatcgtactgttcgttcacattggcgcggtagaaatcgcacagcggctcgtagagggagacggcatcgtggagcatctgaaagccatcgtagagattgtgcacatacgatacggtcacatcgccgctgccgccgcctcccttgacataatcaaaactgccttttccaaagagtgcaatccggctgcctgcttttaacggcagcagattgtgctcgttctttaagagaaccataccctctgctgcagcttccctggaaagtgcgatgtgttctttggaagcagtcacgtaacagccctcttttaatggacggtttggctgatacatcactctggtccatttcttcattttgacctcttttccggcatacgcctgatattattttgatatttttcagtatggaacattgtctatgctcgtattataagcagataattccgtttgttatagatcgaattttggcagaaatataggtcgatattgatattttttccttctgaaggtatgatgggagaaagagaagcccgtgcatgtgaaaacacggagagagcaggaaagagagggagcgggagtgcagcagggggaacatgagattatatccgatgacgggctgatgcagctttattttacacaggtcgacgcgtccaatgaattgctgccggcacactggcatgagcatctggaaatgatctgtatgcagcacggggcaatgacagcgtacatcaatgagacgtcgtatgaactgcagcagggagatattctcgttgtcaatccgagagacattcactacacgcatgtccacggggacgggcattactatctgctgcagattccgccggagcatttaaagcgcgtcagtgaggactggcggggactgcatttcggggaatatgttccgtattcggaggagaccgcatccgtgaattgccggatgtcacagaagctggaagaaatgaagtgcctgcaggagcaggcggcggacggtacgcatctgctatttcttgcagcggtttataagctgctgtatctgctgtatacaaaggatgcggccacggtcgatcatgtgctgcgccaccgctccaggagagattttgagcggatcgagcagagcatgcagtatgtgaaaagaaattacacgaacccgattactttaaaagagacggcagatgaactgtcacttacgccggaatatttttgccgtctgtttaaaaagtacaccggccagacatttttgacttatgtaaatcaaatccgcctgcagtattttcacagtgatctgctgcagacggacgagagtattacttatttaatgaataaaaatggaattaccaactataaggtgtttctgcgcagctttaaggaagcctacggcatgccgcccggtcagcttcgcaaaaagcagagagaagtaagagatgccggagcaatcagtgcgcggtcagcttcttcatccggaaatgatagtaaaacagaaacagaacggacgtcaaaacccaggacaccggataattgaggagcgttacggtgagcgtcgggaagagggcgaccactccgaaaatccataccacacggaacaggcagataccgccggttgtgatgagcatcggaacgacgacgtcgcccatgccgcgcagcgcaccggagaagacctcggtaaagacgaacagccagtaaaacggagccatggtcgccatcattttcagtccgatctccacgacattttcatcggtcacaaaaatgtggaagagcggaatgcggaagcatacgagcaccagcatcagaaggatggcggcagcaaagtccatgccgatgcacacgcggatactttttctgacgcggtcatacttcccggcgccgtagttctgaccgacgaaagttgtgatggcaataccgaaagcaccgctgaccatccagacgatcgcgtccagttttccgtaagccgcccatgcggcaaccgtgtcggttccgaatttgttgagcgcggactggataatcatgttggaaatgctgtacatggcatactgaaatccacccggcagtcccaaaagcagctctgatttgagaagtctcgggtggatacggatgtcttttaaggaaaaatcgcagagatctttctggcgcatcagaaaaacggtaacgattacggcgctgatcccctgcgagagaagcgtggcgatcgccgcaccggcaacaccgagtcccagcccgacgatcaggagcaggtcgagaacaatattgatgacgcagcagatcatcagacagtacagcggacgtctggaatctcccagcgcgcgcagcagtccggctccggtattgtaaataaacacgaagaaaatgccggcaaaatagatgcgcaggtagaggatggagtcactcatcagttcttccggcgtattcatcagtcgaagaagcgccggggcagcagtgatgccgatcagtgtcatgatgacgctgccgatgatggagaaggcatagatcgtatgaatactgtcgtccacctttttgcggtccccggatccgaagaactgggagacgatgacggaagcaccggcagtcagcccggtaaaaaagttgaccagcaggttgatgaccattccggaggaaccggcgaccgcggcaagtgcatttttcccgacaaagcgtcccacaatgacggcgtcgatcgtgttgtaaagctgttgaaaaaaagaacccagtaaaataggaaagaaaaataaaagaagctgtttccagatgataccggatgtgatttcgttcttggaagaggtttcgttcatgctataatctccatatctgtcgtaaaggtataaaaaatgtgaaaataagtccgaaatatattataaaatctgtagcataaaataacaagaaattccgtttatgttttttgcgttctgtgataatataacactatacaatgcctgttgccagggatggacaggaaagccacggaggacacactatggataagaaagagaatcagccacgcgagaaaaagggtatgccgcttgcaccggtctttttgctgggagcaacggtgctgctgttgattgaaatgtattttatcgtcaacctgccccgggtatatctggtgcagattattctgggagcagcaattctcgcctgtacttatgtatttattgctgccttattaaaggagatacataagagcggagagcaggcaaaagacgaatatgagaggatgcttcgcggagaaaaggcgtcgtatctgatgctgaagaaaatctcggagcagctggaggcggttgaccgcaataccagggagccgggcgaggagattatcacagcgcagaaggcgatcgccaaggtgaccattaccagaagcaaggaaaatgcagatgcacttatgaattccaacgaccgcgtagtggacaatctcttacagttaaaggagagcatggatgctggattcgagcagtttgccggaaagcagcagaacatgatggatgattccgttaaggaactcgtcttaaagcagcaggaatttgccgaggaattaaaggaggttaccgcagggcttaaggagattaccgagggacttcaggcagtgaaggagacggttgcagaggaaaaggcgcagacgcttgccgctattgagagccggatggacgaactggtaagccagaatgcggcgctggagagtaaaattgcagaaagcacggcagctgcagcagcgcagaagccggagccagacatggagccggagctgacagaatcagagccggttatgaaagcggagccggagctggtcatggaaccacagccggaagaggtcatggagccgcagccggaagcggtcatggagccggaagcggattttagcatgccggatacaccggaggaggaactgccggttgtagatgcagagacggtgacggatgacaccccggtgatggaagagtatgaggaaccgatcgtagattccgacgcgattgtggaagaggaagatgcggcagctgccacagacgatcagaatgaggctgaggcagagagtgcggcgatagacagtttcgattttggagcagatgatctcgatttcggaggagacagcttagaccttggagtggacggtcttgatctcgggacagagaaccttgacctaggagcagataacttagatgccggagcaggcggacttgatcttggggcagacagcttagacctcggaggagacagccttgatttaggagcagatagtctcgatcttggagcagagaaccttgaccttggaacagagaaccttgatctcggagtggatagcttagatttaggagcagatagtctcgatcttggagcagagaaccttgaccttggaacggagaaccttgatctcggagtggatagcttagatttaggagcagatggctccgatctcggaggagaaagtctcgatcttggagcagatctgaaagaggaagccgcaccggagaatgaagcatcggacgagccagagccagtagccgcgccggagaacgaaataccggacgagccgaaggtggccaagccgcagaaagagcctgagacaaaggcagaggaagctgcaccgatggatttttccgatccacacaagcttatgactccggaagaaattgccgcattgattgcaaaaatgtaagagcaggttccgggataagcaatgaagttattagcagtttcagaataaaaaatgagcgtggaagattctctgaagtaaaatgtgggaatttcttccacgctatttttgtatctgaaacgataatacttatttatatatcccggaacttcctattacgggaatctatgcggcaattctttccgtaatcttacagatcagactccgcgacgatcgtcacgatattcttgatgacggagactgctgtctgcatgccctccacgctgatatgctcatacggaccgtggaagccgtagccgccggtgccaagattcgggcatggaagccccataaagcttaatctggcgccgtctgtaccgccgcggaccgggcgggagagcggtgtgagaccggtcatcgagattgccttttttgcgatatccacaacataaggatgctgttcgatgatctcaagcatattggagtaggaatccgtgatggtaagagagacggttccggtgccgtatttctggttgatctccacttccagtgtgcggagtctgttcaggcgtgattcaaaagaagccctgtcgtggtcacgcacgatataggaaagttctgcaaaagcgacatcacccttcatgtcggtcagatgatagaagccctgtctgccctcggtgtgcgctggtgtctcctccggcggaagctgcgactggatatcgcacgccacaagagcggcatttaccataatatcctttgcctcgcccggatgcacattgacgcctttaatggaaaattttgcgctcgcggcgttgaaattctcataggcgacttcgccctcgtaatcgccgtctaccgtgtaggcaaaagcagccttaaaataatctaggtcaaataaatctgcaccgcagccgatttcttcgtccggggtaaatcccacccagatatctccgtgaggcattccggaagaaatgatctcttcgagcgctgtgatgatttctgccacaccggccttgtcatccgcgccgagcagtgtcgtgccgtcggtggtaatcagggttcttcccttcaaatccttcagcgttggaaaatcagaaacctttaacattgccccagtaccgtttaaacggatgtcaccgccgtcataatccggaatgatctgtggtttgacgtccttgccggagtagtccggtgcggtatccatatgtgagataaaaccgacggccttgcgtccctcacagcctgcagtcgccggaagcagaccgtacacatagcagtggtcggtcagaaccacatttttaaggccgagatcccgtaattcctgctctagtacctttccgagatcaaactgacgcccggtagacggaatttgtaccttgccgtctgtcatgttattctcatccgatgtcgtccaataggacacatatttcaataatcgctgttcaacttgcataagaaacctccttgatctatgccattctatctataaaataacacaattgaaaaaaaaattgaagttttttaaaaaaaatgttgcatttctaaaatttctgttatataataattttcgtgctcgggtgatacagaacacgagatacaaaataagcgccactagctcagctggcagagcacctgactcttaatcagggtgtccagggttcgaacccctggtggcgcattgaaaggtaccgattttacagcattgactgtggggttggtgctttttttgtatttataatacatatcattaaaattttttaaaaaaagagtgtatcctatttaacagaaggaaaagcctgacgatataaaaaacagatactatatgaaggggagagaggcagatggaacaaaagaatattgaggtgcaaaggaaaaaaggtctgaatctgatgatgaagattctgatcacggcaatcataccgctactgattcttgtgacttttgcagggctggcaatccgggcggttggcgtttctgtgtctgataaactgatgcagcatgaattgaagacatcgatttatgcagtcaatcagaccttgtccgttataagcagcggcgactggaatgtggacggagaccagctgtacaagggagattacaatatctcggaacatcaggatgtgctggatgcttttaaggagaataccggactcgatgttacgctcagctggaatacgacccggatggcgactagccttgtgagacaggacggcagccgtgagaccgggacggagatagcagcagatgtgtatcagactgtgaaagaaaagggtagttattttgtgtccgataatgtgattgatggtcagaaatattacggatattatgagggattgtacaacagtgacggttccatggcgggtctggtgtttaccggtatggcgtctacttccgttcacgaaatctacaatgaccgattgaaaaaaaatataatatttatggtagtgcttgcaatctttgcatgtatctttctggcaattgtgatgatgaagattgtgaaggcaatgatgtcgatgatcgatcatctggacgatgttgcggagggaaatctggacagcaggatcagcgaccgcatgacgagccgctcggacgagatcggaaatattgcgcgtgcgctgtattcacttattggcggactggccatgattgtaaaaaacatccggacatccgcaaagtcgctggatgatttcagcgccaggttccagaacagctttacgacgatcaatgagtccattcataatgtgaatacagcgatggaggacattgcgaacggagcgacgaatcaggcgggcgagatgcagaaggtcaatgagcagatcagcgacatgaacgaagccattgccgagacgacaaagaacgtggaaaatctcacgggcagcacggaggagatgaaagagcagaatcataagctcgacggcacgatcaaagatctggtggagatcagcgaccgcaccagagaatcggtggatgaggtcaaccgtcagacagacaggacgaaccagtctgtcatggagatcggcagcgcgatccagatgatcacagatattgcaagccagaccaatctgttgtccctgaatgcgagcatcgaggctgcgcgtgcgggagagcatggaaaaggatttgctgtggtggcggatgagatccgtcagcttgcggatcagtccagtgactccgcgaagaagatcggtgatattgtggaagaactgattaagaactctaacaagagcgtcgagacgatgaacggtgtgctggatgagatcaatgagcagaacgagaagctttcgaccaccagagaggcattcgacggactgaatacggaggtcggcaatgtggtagttgcgattgacaatatccggcgtgagatcgagacagtcaacacggcgaagaatgatgttatgagcagcatggagagcctggcagcgattgcacaggagaatgcggcaagtaccgaggagacgtcggcttccatgacggagttaagcggcatcgtcacggactgcaatgcgcagacgaaaaacctcgtggatattgcagaaaatttaagcgacaatgtcaaccagttccggatcaaagaataaaagaaaatagaacacaaaaaacacccgcaggcggatcgagaaaaatccagactgcgggtgttttttatctggaagcgatcagcttgcagatcggattgccgagggaggagaacttctcctcgtactccgtcatgatattgccttcattgagcaccggatcgtgatgcagatctctggtggaggcgtccagatgccagccggcttccgggatctcctccagggaaaaggtaaaaagatcctgattgtcggtcttgaactccagatgtccctccggcgcgagaacctcatcgtagcgcgcgaagaactgacgggaggtgagacggcgcttggcgtgtctgtccttcggccacggatcggaaaagtttaagtagatccggtctacctctccgtgatcgaatacctcagcgacatcggcggcgtccatgcagatgaaaaacaggttcgggagcggattctcttccattttctgcagggcgcgcagcaggacgctggagtagcgctcgattcccagataattgatgtcgggatgcgctgcggcaagatccatcatgaagcggccctttcccataccgatctcaatgtgaagcggctgctgtgacggaaaaatctcctgccaatggcctttgtgcgtctcggggcttttgatgcagtagacgctctctgtgatggcggcgtctgcacctggtatatttctaagtctcatattgttcctgcctctcataagaaaatcttaataaatgtcgggaagtcctataattgtggacatacaagatattctacaataaatctgtggataaaaaaagagcttttgccagaaaaattgttgcatgtatttttttctgcgattatactgatactagttatgttccggatatatatggaagaaatggacaggatttctggatagaatggagttataagcaatgcgaagagcgaatgtgtggaaaaaggcggcatgtgtcgccttaagtttactatactttttacagataaagccgcaggtggtgcaggcggcagattactggccggaaggaccggaagtacagtcaccgtccgtgatactgatggagatgtcgacggggacggttctgtacgaaaaaaacagcgatgagcggaattatccggcaagtatcacgaaaatcatgacgacgcttctcgcgctggagaattccgatctgaatgaggtcgtcacattttctgatgatgcgatcaacaatactgaggggtccggaatctaccgcgattacggggagcagatgacgatggagcaatgcctgtacgcggttatgctgaattcggcaaatgaatgtgcctacgcagtggcggagcatgtcggcggtacggtggagcattttgtggacatgatgaacgaaaaagcggcggagctgggatgtaccaacacgcattttgccaatccgcacggtctgtttgacgagaaccattacacgacggcgcacgatatggcgctgattgccaaagcggcataccagaacgagaccttccggattattacggggacggcacgctacaccattccgccgacgaacaagcatgatgagccgacggatctgcagaatcacaatgagatgctctacccgttcaagacgctcaagtaccggtatgagtattgtaccggaggaaagacgggatatacggatatcgcgcgtagcacgctggtcacttacgccgagaaggacggcatgagtctggtatgcgtcgtgatgcatacggaatcgccgaatcagtggaccgacagccggaaccttttcgactatgcatttgataatttccagttgttcaatattgcggacaatgagaccagatacatggattccgaggcggtggaagttggagccttaaataacaacaaggcgtttgtggacatcgacgcgaatgccaatatcgttcttccgaagacgaccgactttaacgatgcggcatcggagatcacgtatgacgacgtcagcgagaacgtggtgggaacgcttgcctacacctatgcgggacgtcaggtcggaaaagcagacatagtgacaaccggtgcggttgtggacggatatatttttgacaaccagagcgaggtagagcaggagacagacaccgaggaggagacggtctctacggtgcggatcagaccgcgcacaattttgcttatcgtagccggaatcctgcttgcagtagggttgatctttgccggaaagaagttctacgataactattatattatccggcacaaccgggaagtgcgcaggaaccgcaaagagcagtttcgacagataaaaagcaagtcaagacgccgtagaagacatagaagatagtatagagaaacaaaaaacgacaatattccatgttgaatattgtcgttttttgcgttatggacacgaaaaaaatgataataaattatctgacaattaagcttttcagcaggatttcaagttgattcgggttctttgtgtaaaaaagaatgccgcctgacacagtgtgcgcggtcagatattttccctgaaacagaggggagtccgtgatgcgggaaagcatgtaggaggagacagcatcgtccgcttttaaaaacagaggctggtaatcatccatccggcagacgtcggcatttgcttttttgaaaatataggtaagctcctgctcctgcgctaactgttcggcagtcttgttcggaatgaaatagccgagttcatccttcggcatattcagagagcggatggcgcgctgcacctgtttggtcagagcgtcggacgccgggtatagagactcaaaatatttcatgaaatcggcagccgtgcggaaatgctcgttttttcccttttctaagacctcggtcatcaggatccggcggatgattccctcgcaggtttcccgggacggattcttgcgcagggagggtgattttgcttccatagagaactcctttctgcaaacgacaaaaaaattgtcttttatgacattataagacaaatcaagagctgtgaacagccggaaaaacgacagaaacgataaattgacaaacagcagagtatcctttatagtaaaaataagcaataaataccacaaacatatacattgagcggagaagttatacagaactttccctaaaatgcgtagcaggaggggaaggctcaaaaggaaaggtacggggaacgatatgtcagaatcttatgtgattaacgaaaagagggaactcattctggatcgtgtcaaagagttcatctatcagaatggcggtgtggtgaaaaagagccagctgaatgaactggggatcgattaccggcggattctggattttgtggaaaagggagatctgatccggatcaagaacgggtactatgcggtgcggctgagtgatttctcggaggaggagctgattgcgcggctgtttcctgattgcgtcttaaatctggagaccgcattgtacgcgtacggctatctggaccgcaagccttacggatacaaattgtcggtggacaagaacacatccaagtcgcggtttaagctggattttccgccggtggtgccgctgtatgcggagccggagaccctgacactcggtgtgacggagattgactatggcggcgcgaagatgaaaatttttgaccgggagcgcctgatgtgcgagtgtctgaaatatgaagataagatggagcgcgagcttttcaaagaagggcttttagcgtacatccgtgatccgaagaaggatgttgcaaagttgatgaaatacgcaagggaacgcagagtggtaaagaaagtacagacgatgataggagtatggctgtagatgaaacatacgatcatagaaaaagctgcactgaaagcaaaaagtgaagagaccggtattccgttttccaatctgctggcaggctatgtactggaagagctgatgtatctgatcgaggattcgccgttttccctgtttctgtggctgaaaaacagcggtgcgctcggggtggaacagtaccagaagaaaaatctgttgacgctggattttgcctatgtgacagatccacgcgctatgaagcgggaggggatcgttccggggcaggaactgtctcttaagatgggatatgtcatgctcgcgtacatcctaaaagtggaaaaggtgccggacatttcctggaaaggaagagcgagcgcgggagatcaccgtgtggatctggagattgcgggggagttcgaggagatgacggtcccgatccatatccgcgtcacggaactgaccgaggaaggcctggttccggtcaagcggacttttatgccgtttatggaaggcggaaagcagattccgtatctggaatatccggtggagagtattctcgcggagaatcttttttatctgatccgggatatggaactgcttccggatatgagcgtctacgataaggtttacgggatattaaagacggagccagtggacggcaggcatattcaggaactgctcggcgaacattgcaaaaagcagcagttacttcccgaggagtcgcggatgaaagagattctttcctaccgcgattacagctacatgagaaagcgttgggagaaatatttaagacaccggaaaagaaaagaacccgcatggacagaggtcatgcaggttctggaacaattccttccgcagatgtggagcaccctgtgccgggacgaaatttttttcggagactggatgccggatctgcagcggttcttagattagttaaatgcagtgaaggtgtcggagcgccagatagtagtcgtccctggtatccagatgggaaaattgaagatctgccggaatatcggagtctttggttgcttcttcgcgcttcagataggacacgctgcatttctcgcgcagcgtatcgaaagtgaactggtgcaaaagcagacactttccgatggatggcaggcagcttttggagtaggcggacgccggtactttttgatccgtttcggtgccggataccgcggcgatgtcaaaaccgtccagatgctccagcagctgcagtccgacttctggttccagaaaaggggtgtcgatcggcagaataaacgcctggtcttcatccatcatggagagaccggaaaatacgccggacatcgggccggcgttcatgtacagatcggcaatttctgtgacggggagtgacaggtgtgtatattcgcccggctttttcacggataagtaaatatgcgaaaaatgcggtttgtacttgttcacaaggtattccagcagacttacttcgccaaaaggcagcagggctttatcggttcccatgcgcgtgcttccgccgccgcacaggataatgagtgcgtggttcataaaaatttccgccatttctattaaataaatatatcccatatcataatggaaaacggtggaatgttcaagtgacaaaaattctgctgcgcggatcgacgggacaaaacaagatggattgacaggggaaagtgacaggaataatggagagagagcatttgtatcaacagctaatttcatacggggaatcggatgtctacccttttcatatgccggggcacaagcgccgggcactttcgtttccaaatccgtataccatcgatattacggagattgacggatttgacaacctgcatcatgccgaagggcttatcagggaggccgaggagcgcgcggcgaagctctacggtgcggaccggtcgtattacctggtaaacgggagcacctgcggactgcttgccgccatctgcgctgccgcacggcggggagataaggtactggcggcaaggaactgccacaaagcggtctatcacgcgatttccatgcagggactcgcggcggagttcctctatccggcaatcacgcggggagatctgcagggacagattaccgcggcgcaggtggaggaggcgctgacaaagcatccggatattgcggttgtgatcctgacatccccgacctacgaggggatcgtgtcggacgtcgcggcgattgcggcatgctgtcatgcacacggggcggcgctgattgtcgatgaagcgcatggggcccacttcggattcggagccggattcccggaaaatgcggtgcgccttggggcggacgccgtgattatgagtctgcacaagacgctgccgtcgtttacacagacggcgcttttgcattgtaacggcacgcggattgatcccgggcgcgtggcacggtatctgggcgtctatgagacgagttcgccgtcgtatctgtttatggcgggaatggatgcatgcatcgacctgatccgtgagcagggggcagaactttttgcggaataccggagacgtctggatgcattttaccgtgatacggcggaccttacgcagctgcatgtcatgcggcgggaagacctctgcaaggaagaagcgtatgactgggacgattccaagctgattatctatgcgggcaccatgggcggcgaggcgctgcatcaggaactgctcggacattatcatcttcagatggagatggtgtcggcggactatgtgctcggcatgacaagccttatggatacggacgagggcatgcggcggcttgtgacggcgctccatgagattgatgaaaagaaccggcgtatggcggagccccacgagaccgctgaagagaaccggaagacggaattagacggagaagtgccggaagccggatttacggcgcgcatgtaccggaagaatccgcgccggatgcagatttatcaggcgctggatctgccgtaccgggaggtgccgcttgatgaggcagtcgggaaaatggcggcggattacgtttacctgtatccgcccggaatcccgctcatcgtgccgggagaagttatcacggaagagtttatccggcacatcagagagtgccgggagagaaagctgaacgtggaagggcagggaaatcttgcccccggtcggataaagattgtatatttttaaagactatattatactagaaggtgcagcgaatgggaaaaatctattgcatgatgggcaagagttcaacaggaaaagatacattatataagatgcttctggaagacggggcgctttcgctgaagaagatcattccctacacgacgcggccgatgcgccggggagagacggacggcgtggaatattatttctgcggagagaaggagctgtccggtcttctggaacagggaaaagtcattgaactccgggcatacgatacggtgcagggagtatggaagtattttacggtggatgaccatcagatacaggatctgcggcagaattatctgctgatcggtacgctggaagcatacgggaagctccgggactacttcggaaaggaacgtgttgttccgatatatattgaagtggaggatggaatccggctggagcgcgcgatcggaagagagcggcagcagcgggaaccgcactatgaagagatgtgccggagatttctggcggacgcggcagatttttcagaagaaaagcttttggacgcacagattacgatgcggtttgtgaatgatgatttaaagcaaacggaagaaaatatccgcgattatatattgtctcagaatgattgacggatcagggaaagagggtggcagattggatattaaggtgaatcaggcacagatggtgacgcaggtgccggacacggtgacgacggagaccggcgacggaacgttcaagttcacgctggcgagcgcgatcacggatgcagagcttcaggcgaaggtggacagtctgttatcggacattacgtttcaggggaaccggatcgcggaacatatggacatccgcgatatgaaaaagtaccgcggactgatccgtgattttatgaatgaagtggtctaccgctctcataagttttcaagagagaatttcctggaccgcaagggacgccacagagtctacggactgatccggctgattgatgccaacctggacgaacttgcacaggaactggtcaaggatgagaaggatcacatcacgatcttgagcaagatcggggagatccagggacttctgttggatattctgacttaacataaaacgagggaagctatggcaggatttaaagctattttagggcatgagcagatcatagagcatctgcagaatgcagtcacaatggataaggtatcacatgcatacatcataaacggaccggataagtccggcaaaatgatgctcgcggaggcgtttgcccagacactcgagtgtgagaagctggaggacgtggtgaaaaatgccgcgcagccgtccgacgtggagccgtgtatggaatgtcattcctgtaagcaggcgatgacgaagaaccagccggacatcatctatgtgcggcatgagaagccgaatacgatctcggtcgatgatatccgtacccaggtcaacaacgatatagtaatcaaaccttacagcagcagatataagatctatatgatcgatgaagccgagaagatgaacgagcaggcacagaatgcgctgcttaagacgattgaggagccgcctgcctacgcgattctgattcttcttaccacaaacgctgccgcttttctgccgacgatcttatcccgctgtgtcacattgaacatcaaggcagtgccggatgagaagatccgcggctatctgatgcgcaagtatcagattccggactaccaggcggacgtatgtgtggcattcgcgcagggtaacgtcggaaaagccattcagcttgcgtcctcggaggagttcaacgagttaaaggacgcggtgctccagctgatcaagaggcttcgggacatcgatctgtatgagatgacagaggcggtaaagcagatcgctacatacaagctttcgatcaatgattactttgatctgatgatggtatggtatcgggacgtgctgctgtttaaagcaaccggcgacgtgaacggcctgatcttcaaggatgaagtgtacgacatcaagcggcaggcagagaagagttcctacagcggcatcgagacgatcttagaggcgctgcgcaaagcacagatccggctcaatgccaacgtcaactttgacctcacaatggaactgctgttgctgacaataaaggagaactagaaatatggtaaaagtagtaggagtccgctttcggaatgcgggcaagatatattattttgaaccgggcaagctggacatccatgcgggaatgcacgtaatcgtggagaccgcccgcggtgtcgagatgggaacggtcatgacggagccgaaaggggtttcggaggaggatgtcatccagccgttaaaaccggtcatccgcattgcgacggaggcggacgagaagacggttgcgaagaaccgggaaaaagagaaggatgctttccgcatctgtcttgagaagattgccaagcacaagctcgatatgaagcttgtcgaggcggaatacacgtttgacaataataagctgttgttttacttcacggcggacggaagaatcgatttccgtgagctggtaaaagacctcgcagcggtattccgcaccagaatcgagcttcgccagatcggtgtgcgcgatgagacaaagatcatgggcggaatcggtatctgcggacgtgcgctgtgctgcaacacctatctctcggaatttgcgccggtttccatcaagatggcaaaagagcagaatctttctttgaatccgaccaagatctcgggtgtgtgcggaagactgatgtgctgcctgaagaatgaggaagagacctacgagtatctcaacagcagacttccgggtatcggcgaccgcgtgacgacggtggacggactgaaaggagaagtgtcttcggtcaatgtgctccgccagatggtgaaggtactggtagaggtggacgatgaaaaagaactccgggactatccggtggacgagctgaagttccgtccgcgccgcagaaaggaaaatataaagctttctgcaaaggagctgaaggaattgtctgcgcttgaggataagggaggaaaatccaagattgatgacaccaaataatcttgtccatgaaaacgagcgtctggatgaactgcaccggaacggctactatatcattcaggatccggcgagattctgtttcggtatggatgccgtgctgttgtcgggattcgcgcgtgccagacggggagagcgtgtgcttgatctggggacgggcaccgggattatcccgatcttaatggaggcaaagacggaggcagaagattttaccgcgctggagattcaggaagagagcgcggatatggcgagaagaagcgtattatataatcacctggaagaaaagatccgggttgtgacaggcgatatcaaagatgcctcgggaatattcggggcatcttcttttgatattgtcaccaccaatccgccgtatatgatcggacagcacggaatcagttccggctcggaggcaaaagcgattgcacgccatgaggttctgtgtaccctggacgatattctgcgggagtcggcgaagctgcttgtgccgggcgggagattttacatggtacaccgtccgttccggcttgcggagattatgagcaagatggttgcctgcggcattgaacccaagcggatgcagctggtctatccgtacgtggacaaggagccgaacatggttctgctggagggaagccgcggcggcagatcgagactgacggtggaaaagccgctgatcgtttataaggaacagggtgtatacacggatgaaatctatgatatctacggatattaacaaatgaacgggtatggcggcacagaaagcagcggacaggacgctgtggcagaaaggaaaaaaatatgtttaatgatattgtgataggaccgattaccattcatatgtatggagtgatgattgcagcaggttttctggcggcattgctgatgacgctgcgccggggcaaaaaaagaggctatgatgaggatatcatctggggcattttcttctgcgccatcatcggcggaatgctcggaaccaggattttatattatattgtagagattccggagatcctgaaagatccgtccatcctctgggatttcaagaacggctatgtggtctacggaggaatcatcggtggaattctggcaagttatatctactgccgcacgaaaaagcaggcgtttatgccgtattttgatctggtgatgccggcggtttcgtttgcacaaggcttcggccgctttggctgcttttttgcgggctgttgctacggcagggagacggatgcgtggtacggaatcacgtttcataactcctcgttcgcaccgaacggtgtgaagctgataccgacgcagctgatctcagcggcgggagattttatcatctgcgcgctgctgttatggtttgcatcgaagagaccgaagaccggacgcgttgcggcggcttatcttgtgctgtacggaatcggaagatttgccgtggagtttttgcgcaacgattacagaggcagtgtgggtgtgctgtccacgtcgcagttgatctccatcggcgcggtgatcggaggaatcgtactgtatttcgctgcaccgaagcttgcaggagtggggaatgtggccgaggagaagtctgtcggatagcaggcaggaatgcacgcgggaagtatacaggatgtgcgcgctttatgcacgacgaaaggaaaagttatggcgggaaagttatatttgtgtgccactccgatcggaaatctggaggacatcacctaccgggtggtgagaaccttaaaggaagtcgatctgattgcggcggaggataccagaaattccatcaggctgctgaatcattttgagatccggacgccgatgacgagctatcacgagtacaataagatcgagaaagcgtatcagctggtggataagatgcgcgagggacttgacatcgcactgattacggatgcggggacgccgggtatctcggacccgggggaggatctcgtgcgcatctgctatgaggaaggcattgaggtgacgtctctgccgggaccggcggcatgtatcaccgcactcacgatgtcggggcagccgaccagacggtttgcgtttgaggcgtttctgccgagggagaaaaaagagcgggcagcagtgctctcacagctggtcaatgagacgcgtacaatcattatctacgaggcgccgcaccatctgatccgcacactggaagaactgtatgggacgctcggggaacggaaattaaccgtgtgcagggaactgacaaagcggtacgaagaaaagacattaacgacattttcagagattcttgaatattataaagacaatgaaccccgcggagagtatgtcctggtaatcgccggaaagacatttgaggaattgaagcaggaagagcagaggaactgggagaacctgtcgctcgaggagcatatggaagtttatgagaagcaggggatcagccggaaggaagcgatgaagctggtggcaaaggaccgcggcatcagcaagcgcgatgtctaccaggcgctgttgtcttaaaaaatacttacataaatgaaaatactgtgttatattagaaaacgctgcaaacggggatgaccgtgttgcagcgttttttaccaatatcatattacaattcgcaaaaacattttggtttatgttggaaacgatacatgtgacgcataagctgcgccggggctattggggagccgcatccggcagataataattatccagatacgtttcaatgatcgaaaaaggtgcaggaccgatggagagcagagccttatgaaaagcgatatcgctgtaggcgcttccgtaggtttcctgtgccttttcttttaaatccacaaattccatatatcccacataatatttcagataatgggcgggttcttccacgatcagctcatagatttcgcgcagtgcggtctgatccgtgatgccgaagtctttccagaaagcggttgtgtcggaaaagctccagccgtcgtagtggattcccagatccgtcgacgcatagagactcaggagggcggactgattcagggagagcagcgaggcgaggtcatcgtccagcccggcataatggtacgagatcatctccacataggtcgcccagccctcgacatagcccggataattcagcagaaaccgcacgggatgcagtccggcttcataggacatcaccgtctgataaaggtggccggggaagccctcgtgcgccagcgttgtgaaataccgcagggaggaggtgtcggtggaggcattgataaatatggagttctgcgcataatcgtcaatgggcgaggtgatgtaaaacgcaggcgccatatagtcttccatgcactcgtcaatagaacttacagtaaatgtggtctcgggtggtgcaggaaaatttgcgcgcatcgcctcctgcagcccgtttagcgttgcaatgggatcggcggcaggaagccggacggtcgtctgggatgcttttaactgcgggttttcggagaggagtgctgccgcctgctgcaggtcgctttgccgtttttctaagatccggtcctgcagcgccggaagatcggaagcgctcccggtgttgtggcagaccaggtagcggtagtaatcttttccgtctgcaaagtaacagagccccatatcgtttttgccgctgccgagaagctctgtgagcgccgcggcaagatgggtgtaggcgggaagcacatgttcccgcaccagagcggcatttttttccttgtagagtgtcttttggttttccgtcaattctgacatggcatcgattttgtgatcgaaggtctggatgagatagtgttgatccgggtcagctgtgaaggcgttacactgtgaaatcagtgtgttgcaggcatagtcggacataaaaagcccggcctgtgctttctgctgctcgaagcggatgatctggtcgaaataatcgccggtcagggcgaggagcgcgagatagtcctccacgtcggctggctgccggaaacggtattcctcatatagtacgggaagctgcgactgaatgccggtcgtagggcgcagcggctcgtcgtagagagtcagatcggatgcggagagctccgtcttaagataatcctgcaagacgtcataggtgagctgaccggagggcggaagggcatcgcggtcgtattttgccagagccgcgagcgtgttctccagagatgcatgggatgcggcaagtgcttcttccgagagactgccgagcgtgatcggagtctctgtaatgccgtagttttccggatgggacagtgaaaaatgaagattgatcgtgttggaggagacctccgcccggaaaaaatcatcaagaaacgcatcgaaggaggacgtggaaccggcgacgaaatccgtctgcatggagaagcgggagcatccgttgagcagaaaaacggacgtcatcagtggaaaaaggacgaattgccgggaaaatgtgtggataaacgaagaatgcaaacaaacacctcgggaaacgcggcagtggagaaaactcctgtgccggaaaattaacatattctatgtgggaaaatgtgcaattattcaaaagttctgcgatgcttttgcgcatcaagggggtgctgtcaagatttattccgggatgcatatatatggagaaacgataaaaacgggtgaggggatatgaattatctttgggcatttatgattctgacgggcatcatctacggggcgttccacggaaccctgccgcagattacgacggcggcgctcgattcggcaaaagaggcggttacgctttgtattaccatgatgggagtgatgtctttctgggtgggactgatgcggattgcggaaaaggcggggatcattgagggactttcacggagaatgcgcccggtgctgcatttcctgtttccggatctcccgcaggagcaccccgccaacgaatacattgcgacgaatatgattgcaaatgtctttggacttggctgggcggcaacgccggcgggattaaaagcgatggaggcattgcaggagcgtaacctggaactctgcggacaaaaaggaacctcgcggaaacgcggaccggatattgccacggatgagatgtgcacgtttctgatcgtcaacatctcgtccctgcagctgattccggtcaatatcatcgcgtaccggagccagtacgggagcgtcaatcccgcagcagtagtgggtccgggacttattgcgactatatgtagtaccgcggcggcaattatcttttgtaagttaaaaaaacgttgctgaaaggaaacgaaaaaactataatagtacataggagaaacgcagatcgtgtttcaaggtacgggggcttgtatgggtagaagaaaatatgtactgatcgtagatgactgtcagcaggaccggatggcagtggcggatgttttgagatcggattacgacatcctagaagcatgtaacggaaagcaggcgttggagattctttccagaaaaagagcgcagatttcgctgattatgctggatctgatgatgcctgtgatggacggttatgaatttttggagatgtatcggaagcggaaggagtacagctatcttccggttgtggtgtgtacgacagaagacgaccctgagagagagcagaagagcctggagctcggtgcatgggattttgttctgaagaattccagccccgggatcatgagactgcgcgcaggaaacgccatcgagaaaagcaaggtgcggtttctggaatatgattttcttaccggtatttacggacagcagaagttctaccaggcgacccgcgaacttttagaccagcgcgcgggagcgaattttgcttttatccattttgacattgaccgtttccggattatcaataccctctacggctccaaagagggagaccggctgatccattttgtggcgggagccatccgcaaggtcatgacagcctacggcagaggcacatacggacgccttggcggcgatgtgttcggaatgtgtgtcccctacgaagatggtgcggtgatctatcacatactggaaggaatccgggcagagatccggaaacattccgtacattattatctggagacctgcgcgggcatttatctggtggacgatccggatatggaagtggcggcgatgcacgacaacgctgagattgcggcggcacagtgcaagggtcagtacatggttcacgatgttttatatacggaggagatcggacagaaagtgctccgcgaacagcatatcattgacgagatggatgccgcgctggcagagcagcagtttatcgtctatttccagccgaagtaccagctgaaaaagatggctccgtacggagcggaggcactggtgcgctggaagaagccgagcggtgagatcgtgcttccgaacgaatttataccgatctttgagcgcaacggctttatcacgaagttggactattacgtgtgggagaaagtctgccagttcatagacagtgagctttcccagggaaggaatccggcgccaatttcggtcaacgtatccagagtcaacctctataacccggattttatggattctctgattgacctcatccaccgctatcatattcctccgcattatctgaacctggaactgacggagagcgtcttttccgaggatgcggaattgatccagagagcggtgaattatctgcatgacgccggatttacgattctgatggatgactttgggagcggttactcctccttaaacattttaaaggacgtggatcttgatgtgttaaagatcgacatgaagttcttctctaaggggaataccgcggaaaagggtgcaaagatcatcgaggcggtcatccggatggcggaatctctggacatgatggtgattgcggaaggtgtggaggaaaagcatcaggtggattttttaaatgacctcggatgcgactatattcagggttattattttggccgccccatgtcgcaggatcagtatgagaagctgacgaatcacgatgaggaagagcagcatgacatgccgcagcccgaaagttcgtgaatatgaatatttaccgttcggattccatatagtagaataacggaagattctggatgtatcatgggcgtaatgatttttctatcggacataatgataccgcttctcattttcggtattgtcggttatggaattctgaacagacagaatatctatgaggagttcatagacggggcaaaggacggctttcagacggtcatcggaatcatgcccacactgatcgggcttatggtggcggtcgggatcctgcgggcttccggttttctggagtgcttttccgggctgctgggacgggggatcggctggcttggttttccgccggagctgataccggtcacggtggttaaaatgttctcgtcctctgcggcgaccggtcttcttttggatatatataaggagtacggcgcggattcgatgttgggaaagatggcatccatcatgatgagcagcacggagacgatcttttatacgatgtcggtctattttatggcggcggggatcaaaaaaagccgttacacgctggtgggcgcgctgatcgcaaccactgcgggaaccgtcgcaagcattattctggcgggatatatgtgagcagccggcggctgtggctgcgcccgggaaggattttttctgcaaaaatgtctgtgaaaacagaaaaatgaaaaaatcggttctataggatgtcagctctgcatataatgatagagtaaggcaggaaaaagcagggtgcggaagcggatttgacaagtgggtacgaaagagttataatacattatgttaacaagcaacggacattgtgatacaggaagcaatggtggttgcatatagcgcgggatggagcagtctggaagctcgtcgggctcataacccgaaggtcataggttcaaatcctattcccgcaactttttaggcagcagtcgcatgactgctgtttttttgctttatctaaaagacctgggttctgctgtagctgatgtttgcgttttagagaacgttttccggatctgcggacggaataccaatagattttggcgtgcggttggtgtatgatagagaaaatcgcagtgggatgggaggcgccagtcaatgacgaatatcgaacaatttttgcagatggtgaaggagtcggacaatattgtattcttcgggggagccggtgtatctacggagagcggaattcctgatttccgcagtgtggatggtctttacaaccagaaatatgactatccgccggagacgattttaagccattccttttatataaaatacccggaggagttttaccgtttttaccgggacaaaatgctctgccttgacgcggaaccgaacatcacgcataaaaagctggcggagcttgaggcggccggaaaagtaaaagccgtcgtgacgcagaatattgacggtctgcatcagctggcgggaagtaagcgcgtgctggaactgcacggcagcgtgcaccgtaattactgcaggaagtgcggcaagggatttgatgcggagtatgtgagggattatccgggaaaagtacctctgtgcgatgcctgcggcggtacgatcaagccggatgtggtactctatgaggaaggactggaccagcagacgctggaggatgcggtattttatatcagccatgcggatatgctgattatcggtggaacatcgcttgcggtatatccggcagccggtctgatcgattattaccggggaaataaactggtgttaatcaacaaatcgacgacgccgatggacgcgagggcagatctgctgattcaggcgggactcggcgatgtgttcgggcagattgaggtgtagacgggcgccaggcgaatgaaatttttttctaccgcagcggagcgaaacatgctacactatcactacattaggaaagtgaggaagaccatgaaccagtaccattatgaagtgggagacatcgtaaagctgaaaaagcagcatccgtgtggcagcagtgagtgggagattctgcgcgtcggcgcggatttccgcctgaaatgtacgggttgcgggcatcagatcatgattgcgagaaagcttgtggagaaaaataccaaagggctgcgcaaggcgggggagacggaataggctcgctgcgcagttttttgcgcttttttcaagaaagcacttgtaattacagggaaaacgtgttatagtagatactcgtgatataataattattccttgctcatgtaatgaaaacgtgggccagagaccaaaaggaggaaattcgcatgaataagtatgagttagcactcgttgtcagtgcaaagatcgaagacgatgcgagaacagctacagtagagaaggcaaaagagtacatcactcgtgccggcggtactgtaacagaagtagaggactggggtaagaagaagttagcttacgaagttcagaagatgagcgaagcttattactacttcattcagttcgatgcagagccgactgttccagcagaagttgagcaggatgttcgtatcatggacaacgtacttcgtttcttagttgtgagaaaagacgagaaataagagattctttgatctgataacgtttgtttgagggaagagaggaatcgtatatgaacaaagtgattcttatgggaagactgaccagagatgcagaggtgcgttactcacagggtgagaactccaccgccatcgcaagattttcgcttgcggtagaccgccgtttccgtcgtgacggggacgagcagacagcagattttatcaactgcgttgcatttggcagaactgcagagtttctggagagattcggacgtaagggaactaaattcgttctggagggacgtattcagaccggaagctacaccaacaaggacggacagcgtgtatacacgacggacgttgttgctgagaatgtagagttcgcagagagcaagaatgcttccggcggcggagataattccggttttaccccttccgacagaccgtcaccgagcagtgcagcgggtgatggcttcatgaatattccggacggaattgatgaagagttaccatttaactaatggacgataataacaggaggtaattatcatggctttcaataaggcagcagacaaagaaggcgctccaatgaagagacgcccgatgcatagaagaaaaaaagtttgtgtattctgtggtaaggacaatgtgatcgattacaaggataccaacaagttaaagagatacatctctgagagaggaaagatccttcctcgccgtatcacaggcaactgtgcaaagcatcagagagcgctcactgtagcgatcaagagagcacgtcacgtggcattgatgccgtacgtatgtgaataaacttcgtttaatcacagcgaataagctgataagtaaaaagaccaacaatccttccgattgctggtctttttttaggtgattgcattttcgtaatgtcgctgattctaaaactttccttaagaatagaaaaatgggcttggaaatgagacaagaatcatataatattatgggtatgtgtaagagcaagaggtgcagaggagtgggaacgcggatgagaggacactggtacaaaacgacagtcatgctgacaatggttctgatgctggcaggatgcggcggagatggcgcagaggcagagcagacggtgcagaccgagcaggtggaacagacggagcagacgcttgagcaggtgctggaagagcatttccttgcggcggaggatgcggaggatgtggcgacagtggtctcgcagtacgcggaggagacgccggatccggcgctagcggagtttctgatctcttattatcaggttccggacgaagagcagagcaagacccggtattactataatcatattgatctgaatgaggatggaacagatgaaattttcgttgtcgtggtcggtgagtatacaaaggtatcgttcggtgatccggcgctgatcttatcggaacaggcagacggaacgttccaggtgatcgagtcgtttgagggaatccacacgccggtgacggttagtgagcgcatgacgaacggctggcatgatattatttaccaggaatacggtcgtggagcggaagatggataccgtatctgccattataatccgaatggaggataccagacagatctgagtgaggttgtggatgaggtggagccgcaggacggcacccagatcatctccaacaactttatcgacgatatggataaggggaattatatgacgctcgcgccggcggaagatggcggaagcgaagcgcaaggcaactagataaagcgcaaaccaactagatatagcggctgaaattttggactgtccaacttgttgtgggcagtcttttttcgggcaaaaaaggctttatattgggcggtcaaaatggtataatgcacggtatgatagtgtttttgtatagaatgatggaggcttgcttgtgagaaaaagtaacgtaaagattaaaggaaagcttcgtacatatttgtatctgccgctgctgcttacaatgcttctgattatcatcaatgtgtttgtgtatatggaagacacttcttcgggagtgcttttttctgggtttgtactgctctattttgtgatcatgctgatcgcttatctgcgcaataagccgcttctgatcgatgagctgatcaattttgcgacgcagtacggtctcgtgcagaaacagctcttaaatgagtttgaaatcccgtatgcactggttgattataatgcaaagtttctgtgggtgaatgagcagtttacggaggtcacaggaaaagacaagaagtatcataagtcggtcatgacggtattcccgacgctgaccaaggagctgctgcagcggagcgagccggtggagtcgatcaatctgacatacaatgaccggtattaccgtgtggcgttaaagcgcatttattttgacaccatgacacacgacagcacgatcgtatcgctcgatgagagcaatgaatatctgacggcgatgtacctgtttgatgagacagagttgaaccgctacatccgcgagaacgaggaacagcgtctggtggcggggcttgtatacatcgacaattatgacgaggcgctcgacagtatcgaggacgtcaagcggtcactgctcgtagcgttaattgaccggaaggtgaacaaatactttacagagattgatgcactcgtcagaaagatcgagaatgacaagtattttgttgtctttaagaatcaatatctcggaaagctccgggaggatcgtttcagcatcattgaggacgtcaagacggtaaaagtcggcaatgagatggcagtgacgctcagcatcggtatcggcgtcggcggcgattcctacaccaagaattacgagtacgccagaatggcgattgatcttgcactcggacgcggcggcgaccaggtggttgtccgcgacaacgaggatgtgacttattacggcggcaagaccaacaagcaggtggagcgcaacaaccgcgtgaaggcgagagtcaaggcacatgcgctgcgggaggtgattgagagccgcgagcatgtgattatcatgggacacagcatcagcgatgtggattccctcggtgctgcgatcggcgtgtactgcgcagccagagtgctcggcaaaaaggcgcagattgttttaaatgaggtgacatcttccctgcgtccgcttgtggaaggattttccgaggaaaaaggctatccggcggatctctttatcaagagcgaggaagcaattcttctgacgaaccgcgatacgctcgtgatggttgtggatgtgaaccggccgagttatacagagtgtccggagctgttaaaacgcacggatacggtgtgcgtgtttgaccatcacagacagagcagcgaggtcatcgagaatccggtgctttcctatgtagagccgtatgcgtcgagcgcctgcgagatgatcgcggaggtgctgcagtatttttccgagaatatcaagctggagccgcatgaggcagactgtatctacgctggtattctgatcgacacgaacaactttatgaccaagacaggtgtgcgcaccttcgaggcggcggcatatctgagaagagccggagccgaagtgacgcgcgtgcgcaagatgctgcgcaacgacatggcggcctacaaggcaagagcggaggcggtacgccacgcggaggtttaccgcggtgcatttgcgatctccgtgtgcccggcggataatgtggagagcccgacgattgtgggcgcacaggcggcaaacgagctgttaaatatcgtcggtatcaaggcatcgtttgtgctgaccgaatatcagggcaagatttatgtcagctcacggtcgattgacgagatcaatgtgcagctcatcatggagcggctcggcggcggcggtcatctgaatgtggcgggcgcgcagttgacagactgctcggtgctgcaggcaaagcacatcattcaggatacgatcgacgagatgttaaaagaaggcgacatcgaggaataatacgatttgggaaatacaagataagcgcagcagaatgcgcggaaatgaggatcatatgaaagtaattttattgcaggatgtaaaggcattaggaaaaaaaggcgacgtggtgaacgtcagtgacgggtatgcgagaaatgcgattttcccgaaaaagctgggacttgaggcgacaccgaagaacctcaatgatctgaaattgcagaaccagcacgcagacaaggttgcacaggagaattacgaggcggcgcttgcgcttgcggaggaattaaaggataagaaaattacggtcaagatgaaagccggcgagggtggacgtaccttcggatctgtttccacgaaggagatcgcggcagcggcaaaggagcagctcggcatggagctcgacaagaagaagatgcagcttccggagccgatcagaagcttcggcatgacagaggttgccatcaggcttcatccgaaggtaacgggaacatttaccgttcatgttgtagaagagtagcaggaggtttatttcatggaagaggcactggtaaagcggattatgcccaacagtcttgaggcagagcagtccgtgatcggttccatgattatggataaggatgccatcgtgacagcgatggagatgctcatcagcgaggacttctaccacacgcagtacgggattttgtttgatacgatgattgaactgtacaacaagggtctccctgtggatctggtgacactgcagaacaagcttaaggaaaaagatgttccgccggagattgcgagtctggagtttgtgcgggatctggtgacggcagtaccgacttcggcgaatgtgaagtattatgcacagatcgtcaaggacaactcgatgcgcagaaagctcatcaagctgaatgaagagatcgagaatgagtgttatgtcggcaaggaaagcgtcgagacagtcatggatatcaccgagaagaaggtattcgaccttctctccacccgcggcggaggcggcgactacgtgccgatccggcaggtcgttatgaatgccctcgagaagatcgagaacgcggcaaagacttcaggaacggttaccggaataccgaccggatttattgatctggattatcgcaccgctggtctgcagccgtccgatctgatcctgattgcagcgcgtccgtctatgggtaagacggcgtttgtactaaacattgcacagtatgtggcatttcacgaaaatatgtgtaccgccatcttttcgctcgagatgtccaaggagcagcttgtcaaccgtctgttttctctggagtccagagtggatgcgcaggcgctccgtactggtaatctctcggatgcagactgggagaagctgatcgagggagccggaaccatcggtaattccgagctgatcatcgatgatacgccgggtatctcgatctccgagatgcgaagcaagtgcagaaaatataaattagagcatgatctgaagctggtcatcatcgactacctgcagctcatgtccggttccgggaagtcaacagactcccgtcagcaggagatttcggatatttcccgatccctcaaggcgctcgcaagagagctttccgtgccggtgattgcactctcccagctctcgcgagccgtggagcagcggccggatcaccgcccgatgctctccgatctgcgtgagtccggagccatcgagcaggatgccgatgtggtaatgttcatttaccgcgatgattattacaaccatgattccgatatgaagggaatctcagagatcatcatagccaagcagagaaatggtccgatcggaaccgtcaatctggtatggctgccgcagtacacaaagtttgcgaatatggaaaaataataggatggaactgcagcaataagcatagacatcttttgggtgataagtaatattattagaaatagatacttaaaagttccagataaacatgcggcggcaaatctgaccgcaaaatctggtatttctaaccatgccgcagctggcatccgtgatgatccatgtctttccaagtttggagcactctacggattgtgtccgcaagccggcagacaattttaggacttttgtgtgtgtcccttatggccacctctgaacaaaacataaccgcgcgaagccgatgtctgagtcggcatctgccttattttcaatagcagatgccgacgagtttcggttcgcgcggttttatattgtctgtgaagaggtgccattagggacaccagaaagtccgctcattgtctgcggcttgtcggacacactcctagagtgtccaaacgtggcaaagacacggaatgggatgccagccgcggtatggaagaaatacacgaattttgcttcaaagattttgccgccgtctgtttattctggaacttttttgtctctggttttcctgtaatattacttatcaccccaaagcgcgatatgcttattgcggcagttccattcttatggggagtaccttacacaggtatcaagaaagagtacaaaaacgggctgcggcgtatggaaacgttgacaatcgttgaaagcggcggtttggcatgttaccattggaaaatgtctcacattacgatccgaagcaaaacaggaggaacagatcatggatgcgaatataacaggactgtcggcgcgggaagtgacagaacgccgcgagcgcggggaaggcggcgctgccgcagagcgtattacaaaaagcagggcgcagattgtccgtgaaaatgtatttacattatttaatttgctgaactttatcattgcagggcttttatttgccgtgggtgcttacacaaatatgctgtttctggcggtaatttttttaaatattgcggtcggaattgcacaggagctaaaggcgaaaaagctggtggatgaactctcgattctaaaccgtccgggcgtatgtgtgcgccgcggggcaaaggacattcaaatcgagctggatgaggttgtaaagggtgatttgatggtgttgcagagcggcaatcagatctgcaacgatgcggtggtcgtggaaggcatgctggaagtgaatgaatcgctgctcacaggagagagtgatgcagtggtcaaggaggctggaagtgagttatattccggaagctctgtcatttccggtaaggcatatgcgaaggttacgcatgtcggaaatgaaaattatgctacaaagcttgccaacgaagtaaaaaaggaaaaacgcgtggcatcggaactgctgggctctatgaataaggtaacgcggtttaccagtatgctgattgttccgttgggtgtgattctgtttttcgaggccttcctgctgcggcaggcgcccatgcgggaagcggtggtgtcgtccgccgcggcgcttcttggtatgctgccgaagggactggtacttttaatctcgatttcactggcgaccggagtcatccggctggcaaaaatgaagatcctcgttcagaatatttactccctggagacactggcgcatgtggatacgctgtgtctggataagacaggaacgatcacaaacggaaagcttacggtggacgccgtcatggagatcagcgcggggctctctggaaaggcgttgccgcagggcgaaccggaaaaactcgtgcagtcgtatctggcggcctccgacgacaacaatgcgacattccaggtgctgaaagaggcgtttggcggtcaggcattttatacaccggcacataagattccattttcatcaaagcgcaaatggggatgtatcagttttgcgggatcgggcagtgtttttgtcggcgccccggaaaagctgatgcgaaagctgccgggggaactggaacagaggctggaagagggctgccgggttatcattgtgggctatgtcccgatgcagtgggaagacgaagcggcgctgccggaagagatacagccgctctacggggttgtcctggaggataccatccgtgagaacaccagggagacgcttgaatttttccaccgggaaggcgtggacgtcaaggtaatttccggagatcatgtcaagacggtctccatgattgcaaagcgggcaggactgcaccggtggaaggatgccgtggatttatcgacgctcggagaggacattgattatgagcagatctgccagcagtacgcggtgtttgcgagagtgacgccgggacagaaaaaggaactggtgtgtgcgctgaaacgacagggacaccaggtagccatgacgggagacggagtcaatgatcttctggcgctgcgggaggcggactgctccatcgccgtggcggacggaagcgatgccagccgccagatcgcgcaggtggtactgctggattccgattttaccaatcttccgcaggtcgtgatggaagggcggaaagtcgtgaacaatgtcacaagaacggcgagcgtcttctttatcaagaccatctactcggtgctggtttcggtgatctgcctgctggcaaacattccgttcccgtttatcccgattcagattactgtgctggatgcggcaatcgaggggtatccgtcgttctttaccatctgggaatccgacacgcgcaagatacgcggcagattcttaaagacggcgttatccaatgcgctgccgtttgccctcacagtcacggcgatggtcgcagtcaccagtatcattgcaccgtttacggtggagcagcggcagacagtcatgtattttctgctgatctttatttccatggcagccgtggtgaagagctgtattccgtttaacggcctgcgcaccttcatctgcatcacgatggtgataggaacctttggcggtctcgccatcctgccgtcgctgtttgagatcagcgcgattaccgccgggatgggaaaataccttcttgcggggggaagcttatctgtcgtctgtctgctgcttttgcttggaacacgcggagttctcggcagaaagagattgtcagaggcagaggcggtgcggtagagaaccggttttccgttatattttaatagaaaaagaaaagcagagatacctttgatgcatttggtaatgcggtatctctgcttttttggtatagtaaaaagacagggggtgaagcggaggatggataaacgcagcacatcggaagaacagaaaagcggatacctggggctgaccagggcagacgaggagcggcatttggcggacgtgatctcggttgcacagcagaatctggaacgcgccggggcggacatacgcaaggttaacgaagatctggcggatcttctcgagacatacgacgtgaaagacaaagaaggccttgcactctggaataatgcgacggcaagattaaaggaaaatgaatacgatctgatccgctatgagaaggcgagaaaaaagccctacttcgggagaattgattttaaggacggcatctcccaggaggaggagacctgttatatcggaagagccggaattgcgaaaaacggctcagagccggtggtgctggactggagagcgcccattgcatcggtatattacgagagcagcatgggaccctgcacttatacggtaagctccgagggaacctatgagatggatctggtgcacaagcggacgtacgagatcgaacaggatgtgctgaaggatttcttcgactcggatgtcgttgccaatgatgaacttctgacaaaataccttgcaaaaaacaagaaagcggtattgggagagatcattgcgacaatccagaaggagcagaatgtcatcatccgccgctcgccgcggacgaacgtcatcattcagggcgtggcgggttccggaaaaacgaccgtggcaatgcaccgcatatcctacattttgtataactataaggatgatttccggccggaggatttttacattgtgggaagcaaccggatccttctgaactatatcacgagcgttctcccggaactggatgtgtatggaatccgtcagctgacgatggagcagctgtttgtccggcttctatatgaagactgggacgatgcacgctactcgtaccacagtatggagagagacgatccgaaaaacagtgtcaagtgcgatacggagtggttcctcgatttaaaaacatactgcgaagaatatgaaaaagagagcgtgccggcggaggacgtttatctggaaaagacaggaaagcttctgatcggtgcggatgagatccgccgctatctaaaggagcatccggcggactccatggagagcaaaatgctgatgctgggggagattgttcattccagatatgagaatgagatcctgggaagagacatcacgtttccggcagaagagaaaaagcggctcgaccggaaatacacgatgtactttggaaagggaaaatgggagggatcggtctatgccttctatcaggatttcctggcggcgcaggcagcccgtggcagggaagtaaccccgccggggaattcctttgacgtctatgatctggcggcgctggcctatatctacaagcggatcaaggagacagacccggttagggaggcgagtcatgtggtgatcgatgaagcgcaggacttcgggatgatggcataccggtgtatggatgcgtgcctgtcggactgcacctacacgatcatgggcgatacctcgcagaatatccattttcagtacggcctgaatgactgggatgaactgcgcagactcatcctgaccggcgattatgacgcttttgggcttctgcggaaaagctaccgcaacacggtggagatctctacatatgcgaacgagattctgcgccacggggatttttccatctatccggtggaaccgatcatccgccatggcgccggggtctgtgtggaaccggtgcagggagagcgggcgctgcttaaccgggcggcggagacgatacagggctggcagagaaaaggatacgagaccatcgcggtgatctgtcgggatgaagaggaggcagagcgggttgcggctcggctggcagaggacgttccggtaaagaacggcgcaaaaggagagacggaggagttcggggacggcgtcatggtgcttccggtatcctacacgaaagggctggagtttgacacggtacttctgtttgacccgtcggagaaaaaatatccgtcggacaacggtcatgtaaagctgttgtatgttgcggcaacgcgcgcgctgcatgagctgacgattctccatcggggggagttgtccggaattcttgcgggcagggcgccgcaggataagcatataaaggaatttgcggcggaaccgctcacaaaagccagggagtatgagaagcctgtccggacaaaaaaggaacagatgcagcagcgcagggtggaaggcgccatggatatggcggagcgggaatatttcggccccagacgcattgcggcaaaagcgcctgcggcggaggagaaaccggtcataagaccggcggcatcaccggcggtccgtccgcagacagagacagtgcgcgggcagcaggcaaagacagtgcaccgtccgcagaccggggcaatgcaccgtccacaggcagagacagtgcgcgggcagcaggatatggcgacgtctccggcgccggcagggaagcgtccgggaccggagggaaccaatccgtccccgtatgcattcgggacgatcccggagaataccagtctgcgcgtccgggggcacgcaaagggaaatcatgcggtccggtgggtaaaaaagagcagatcctatgtagagatggcgagcatgtacgggctgatgcggattacgccggtcgctccggacatcatccgggtcagctttgtaaaaggagtgacggaaaaaattgcagctacgggctggatggccaaagcggaggaagcgttttcatggagcgccagggaatccaaaagcgttgttgagattgctgcgggtgagattacggtgcgggtagataaacggagcggagcggtctctttctggaacagggagaatcagcttctgcttgcggaaaatgccgcggagccgagagtgatcggcgaggagggaagctgggtatttttcgactgggacaagaaagagcgcatcaaggcaaagggcatgctcgatacggattttctggatgtgacattaaatgcgcgttatatatccttcggagggaaaaagcatagaatgccgcttgtgctgtcgaaccgcggctatggcatcgctgcggcggcaaaaaatacggtgctgctctgcgatattaagacgtacgggcaatatctctacgcggaaggcgagagacagctcgactactattttatctgcggggagaagccggagaatgtcatcacacgttataaagggttataggaagaatttacgtttacattttacaaaaacctcttgacttggagtgaactccagggcttacaatgcctaacgaacagagagttccagggcaccggaaaggagcagaggacatgacaattaaagaaatcagtgagaaatatcatattaccgcggatacgctccgctactacgagcgagtgggaatgattccgccggtcacacggacggcatcgggaatacgggattacggtccgaaggatgagagctgggtttcgcttgccatctgcatgcgcagggcaggtctgccggtggaggcaatgattgaatatgtaaagctttttcagcagggcgataagacgatccctgcgagattgcagcttctggtggagcagcgggaacttctggaggaacagcagcggcagatcgaggagaccaggaaacgtctgaattacaagatctcacgctacgaagaggcaatgaaaacaggaaaactgacatgggaggagaacgaaggatgtcatacgaattttataacccaacaagagtcctgttcggagcaggacagttaaatcacttacacgagcagaagatgcctggaaaaaaggcaatggttgtcatctcaaacgggaaatcgaccagagcgagcggcgcacttgaccgtacgatgaaagagctttccctcgcaggtgtggaggttgtgctgtttgataaggtcggagcgaatccggtcaaggagatcgtcgaggaaggaggacattttgccaagaaggaaggctgcgatttcattgtcgcactgggaggcggctccgttatggacgcggcgaaagtcatggcaatgtatgcgcagcagccgggagatctctgggattatgtggcaggagcaaccggaaagcagcagccgttagtgaatccggtacttccggtcatcgcgatcacgacaacggcaggaaccggatccgaggtggatcagtggggcgttgtgaccaatccggcaacaaatgagaagatcggctgcggcggcatggatgagctgtttccggtgattgcggtggtagatccggagctgatgctgaccgtaccgtcaaaattcacggcataccaggggtttgatgcgctgttccacagcgtggaaggatacctctcggttgtgaacagcctgatgtctgagatggtccagcttgcggcgatcgagaatatcggaacctacctgccgcgcgcggtaaaggatggcagcgatctggaggccagggagcatgtggcatttgccaatacgatgtccggctattcgatggtggtcggttcctgcacaagcgaacattcgatggaacatgcgatgagcgcatttcatccggcgctgccgcacggtgcgggactgattatgatttcggtggagtattacagacactttatcgaaaaacactgctgtgatgagcggtttgtccgcatggcgcaggcactcggcatgaaagatgccaaggcgccggaggattttatcacagcgttaaagaaactgcaggaggactgcggcgtatcagacttaaagatgtccgattacggcatcgaaaaagaggagagcatggttctcgccaggaatgcaaaggcgacgatgggtggactgtttgcctgtgatccggtgccgatgacagacgaagagtgcgcggcgatttatgagaagtcttaccgctagagaaggttgttttaaacattttaacttatagaaaaaagagttaagaatggaggattatgatgagtcagaagagtcttgtagcttatttttcatgcagcggcgtcacaaagaagacggcagagcagctttcggatatggcaggagcggatctgtttgagattcgtcccgaggtgccttataccaaggcggacctggactggatggacaaaaagagccgcagcacggtggagatgaacgatccgtcctcccgtccggcgattgcggacaaggtagagcatatggagcagtacgacaccgtctatgtgggtgcttgagttataattgggacaagttagaagaaacccagtaaaatcaaggggttggaactaatttagtccttatttttatacctttaaatcggtacaggatagggcagcgctgacatatcaatccgaaatatgaccattacatagagcagttcagattcatgggctgagtgtgctttgtgtacccaagagaggtgaaaattgaatagtaataattttaggtaggactaaattagctttgcactgaaaagtgtatccggctgtttgtcctgccttttttattggaaatgagcaggagatggcagaaaagaagctgatttggtctgaatgtaagtcatctcgcaaaaagagaggtggctgtatatggaagtattgtcttatgaaagcaagagcagagtgtgatcgaatataaatcgctggcagatatttcagagacaaggaaaataggatagaaacacaaaccgaaaggtacgggtagctgtatgaacaaaattagtaagatttggaggaacagaaaaatgaataacaagttagaagtaataggaattgatcacggctggtcaatgatgaaaaccgtaactcaggtatttgtcacaggggtaaaggagattacaactactccggcactttttggagatgttcttgagtacgacggtaagtattacaagattggaacagtaaggcaggaagtgaaagatacaaaggttgaagatgacagcttttatcttttgacactggcagcagtcgcaaaggaattgaagaaaagaggattgtcagatgcaaaggtatttcttgcagtaggacttccacttacccgatttggagcagagagaaataactttattaaatacctgaccaagaataagcgtgttgatttcagatatgaaaatgaagcataccatattgagattgacgatgtggcggtattcccacagtgctatgcggctgtggttgacaagataccgactatggcaaagaaaacgctggttgttgatatcggtagctggacaatagatattatgcccgtgattaacaagtcaccggacgaatcaaagtgtgttaccgtgccaagaggacttattacctgtatgcgttctatcaatgagcagtgtgtaagacagctcaatggggaagttgatgaaacagaaatccagaatattatgcgatatggcaggtctgatatagatgatgaataccttgcgattatcaaggctgagatagaggactttgttgaaaaggtatataactcaatccgtgagtttggttataaccttaaaactacaccgattgtatttgtaggtggcggggcagtggtaatgaagaatttcagcaatcacgaagcaaagaatatctcttatatccttgatgtaaaggcaaatgccagaggatatgaacagcttgccattatgggattgaaaactgctaagagacttgcatagggggtagtcatatggcacgaaggcatattatggagagcacattccgactgaatctgctcaatcctcaacacgctaaaatcaatgaggtcataaaggggcttaatccaaagatatataagtcaaagaatcagttcctgattgaagcctgtgagttttatattgaccactatggagaggatgatattccctccaaagaggaaaagagatatgaacagtttgtaacgagggacgagatagaaaagataaaaaaggaaattgagtattctgcaatgagtgaggcaagaaaagaggtcatttctttacttgggggagctttggcgggagtgaagaacagccagccggtagtgattgcaaacccacaggaagatatggaagaacagccggaagaagatgttatgaatgattcagatgttgcaggattggcaatgggatggatgttgaaaggagattgattattatgagaagaattgcaggagccgtaggaaccgctgttttacaggtactcaagtggatgctgaaaattgttcttggagcattcaagctgttcttgggacttgtcaggttagttcttcttctattctgtctggtagcaagagcatttctttcattcgtaagaatgggaacattttgaggggaggtgagactatggaggtaaaaggcttctttcctgcttacaggaaaaacagaagacttgtgaagtatttctttaaatttaagaaattgttataatcaaggaggttaaaatgcacagaatacgggattgtccggaatgagctgacgggtatatcaaagagaaaataaaaacaatcaaccttgcgggggaatgtaagccaatgacttatgttcccccgctttttttgtttggaggataagcagatatgatgaattatgagatttttaaggaagtagtaaaagagaagtttatggactatatgccggataacttcaaaggtatggagcttgtagttatgcctgtggaaaaggtaaatatgacctatgacggtatcagtatcagaggcaaagatactaatatttctcctactatttatatcaacgatatgtatgagaaatatcagaactgtggtgatctggaggaaacactgatggcggcatgtgaccttatggcaatggagtttgcaaagacaccacaagttgttgatgttgacagcttatacaaagatgccaatgaaaaggtagtattccagcttatcaatacggaacagaacaggtcatttctggagcaggtgccacacagagaatttcaggatctttccattatctataaacttgtgataaatgcggatgctgaaagtattcagagtataaaggttacgaacagccttgcggaaagatttggaatgaatgaggagcagctttttaaatatgcggctgaaaacacaagaagaatcttaccgccaagaataagaaatatgaatgatgttatgaaagagatgtttttaagtgacgggatgccggaggagatagcagagatgatgatcagggaagttccaccggagcagactctgtggataatctccaataacaggggaattgacggtgcagtatcaatgctttatgagaatgagcttcacgaactggcagaaaaccttgaaagtgatctgtatatcctgccttcaagtgtgcacgaagttcttgcggtgtctactgagctgaccgaaccggaggagcttgcacagatggtggcagaggtgaatatgcaggaggtggcattggaagaacgactttccaatcaggtgtatcactatgataaagatttaaggaaactcacacttgcaacggatacaccgaacaagagactggacggtatcgtggcagagccgcagcttgtatatgacgcaaaggaaaaggcgagataggaggcagttatggagcaggaacttaccgtagaagaactgattgctcttgtaaacagccagaaaggtgactttattatccgtattgagtttggagaggaggcggattcctgtgacagagaagaacgacttcaaacttgatgttgtatccataaggcttgtaaaggaggctccgatttattcggagcagtcctttaacaagccggaagaagtagctgccgtaatgggagaatgtatgtgccagttcgacagggaagtggtgtgtgttgtaaatctcagctccgacctaaagcctattaatgtgcattttgcaagtgtgggttcgttgaatgaagcaatggcacacccaagagaattatttaagtcaagtattttaagtaatgctgccagtatgatgttgatccactgccacccgtcgggaaatatatttcccagcaaggcagacacgatgatgacggaccgtatgaataagctgtgtgagcttattggaatccctcttttggatcatatcatcgtgggaggggataaccgtgccttcttcagtttcaaggaaaagggaatgattgataatccaagaattacactcagtacggattacaggaaccttgatattaagtcaccgcttgtggcagagcagggaaaggcaaggtgagagtatggaaggaagatttacagaggaggaacttgccatagcaaagagcgtagatctttgtgccgttgcagaaagtctcggttataccgtaaagaggattggaaaatatcacaccttaaaggaaatggactcaatccgtatctatgaccgcagtcattggtacagatggtcaaggcagtttgataagggaaataatggcggctcacagatagatttcctccgtgtatttggcggaatgagtgtaaaagaggctgtattctggctcttggattttgccggataccggagaattgaaagcacgggaaagcagccgcttgttcatcaggtcacaaagaaacagccacaggaaagaaagccttttgtgcttccgcagccagcaggggataattcctacctgatatcctatcttaacaatgagcgtggaatcagtaaggcagtgatagaactgtttttaaaggaaaatctcatatatgagagcaggcattatcacaatattgtctttaaaggaaatgacaagaatggagtaaccagatttgcaagtatgcgtggtgtatttgataaacagggaaaaccattcaagtgtgatgtggaggggaatgataagaactatggatttaatgtggtgaatgtaaacagtacagagcttgttgtattcgaggcagcaatcgaccttatgagctatgtggatatatttgccgaccatgaatcaaataagctggctcttggaatgcttgcagatgccccgcttgcaacttttctcagggaacacccacagatttcttttatccgtttctgccttgatggggattcaccgggcaggaaagcagccgcagaacttatgggaaaatactatggactgggctatgaggttgaggactgtccgccaccagcaggctataaggattacaatgaatggcttgttgcaacaaaacttaatcttgcagatcagaaaaaggagcagatgaccatagccggacagtgccattaaaaagtggtggtaaaaagcagtggtttttacggaagatggtggaacaaagcggtggttttttcaaaaagtgatagaacaaagtaccaccactttccgatgctgttttttcctatgaatataaattataaaaagtggtggcataaagcggtggtttttaccggaaatggtggaacaaagcggtggttttattcaaaagtggtggaacaaagtgccaccactctatatttggcaggggtattaggggaatgttcccctaactagatggcattaggacagagatgtctctaatgcgtatctagcagtcgccggggacttaccggtgactggagccatagtgaatatctacgaaacacggataaggaggtgcaaggtggcagagaacagggaaataacacttttttcagaaccagaggaactgattgcctgggcagaagtatatgataagcaaatcaacccttcgatagaagatgctgcacttcttcttaattatatggaaggacatgattatgcaatcggaatggatgcagaggggaagatgtacagacaggatatggcagaggaaaacggtgagatagagccatttccgatagatgatgtgattgataaggtgtgtgagtggaattatgatctgatacttcacgcagaggcaaagaaagatgatccgaaagattttcaggaatattgcgaatttcagaaaaagtatgacagtttaaaggcagatgagagggtgttagaccgattatttgataaaaccagtcatgcaaaggagattgatgctgttgcaacggcactggtggaagcgtttatcagtaatctggagggcaagggtgatttggaaaaggcggcagccacgatagcacaaggaataaaggattacagtacagataagaggggaaggtgagcgtatggcagataaaatccactgtatcaggaaaacgctccgtcttatgccgcaggaggcagaaatgcttgcaaaaaaggcaggggagagcggaatgtgtgaagcagattatttaagactgctcatcagccagaaaccgaatgattacccggaagtcagggaactcttaaaagagcttatcaatgaagtgaaccgtattggaatcaatatcaatcagatcgtattcaataacaatgcaggactttattccaaagaggataaaacacagcttgttgcctatatgcgtaaactgaacaagaaagtaaatgaggcggtggtgcagattggcaatcagtaaaatccttaatatgaaagattgtggcgggcattttcacggaaaacatttaaagcgggcacttgattatgtgatgaacccggacaaaacacaggatggcagactggtgggtgcaataaactgtcaggtcgataccgcatttgagcagatgaaggaaaccaagcgtaattttggaaaaattgataagcgtcaggggtatcatatcatactttcctttaaggaaaatgaggtaaatccggatacggcatttgaaattacacagaaatttgtggaggaatatcttggtaagtcatacgaagcggtgtttgtggtacacgataatacagcccatgttcattcccatatcgtatttaacagcgtgagttttgtggacggtaaaaagtaccgttacgaaaaaggggactgggcaaagtatatccagcctatcacgaacaggctgtgtcaggaatatggactctccattattgatgtggatgatgagaaaaaggagaggcagcacgaaagctataaggaatggagtgagtacagggagggtaattttgtatggtccgatatgataaaaagagacttggatgcctgtattttgcaggcgaaggactatgaggaatttctcgaactgctgtctgaaaagggatatcagataaagcagggaaaacatctggcaatcaagccacagggtatgacaaggttcagaaggtgcaaatctcttggggatatgtattgtgaggaagcaatccgggacaggattgtaaaagaggatattgcgttttataagagtaaacaggatataccgaaagtttccattgtaaagtgcagagttaaaagataccgcagggcaggcttgtcaggacttcagaaaaagcattatgcgaagctgtaccgggtgggaaaactcaaaaaaagaccatacagtcaggtatggaagtacagggaggatatccgtaaaatgcacaagctgcaggaacagtatttgttccttgcaaggcataatatccattcagcagaagaacttgtggggacgatagcttctcttacggataagaaaaaagagacttcggcagaaaagagccggatttataaagcaagggaaaggagcatggaactttttactgcggctgatgagatggaaaacttaaagccagcagagcagtcatacaggcttggagatatcttctttgaagatgagcataggaagtgggtggcactggagcaggaattacaggcacagggatattcgcttgaggaagtgcaggctttaagaagacattacaaagaggagtattcagaagtgtgtgcgagagaaaaggttgtatgcagggaactgaatacgggtaaggcaatattaaacagcatgatcccggacagtatttcagatggaagaaagaccgaatacaacagagagattataagagacagaaaagagcagccagtaagataggctgtttttttacgcagttaggaggagcatatggaacaaaatctgaatgacaagccgttaagcaatatgcagattgccagatatattgagtcattgagaaaagaaatgaatttcgatgatgaggtgtacgggcttgtaaaaagtgatcttgaggatggacttacgcaggagcagacggaaaagtatttggataagaattttaacatcggacagatgagagtgttatcggaaggtctgcataaggggattccggaggaactttttaatatccttcacaataataagctctccggcaatcagatgaaggtatcactggaattttatgaaaagggagttccggttgaaaccatacaggaagctgtggcaaggggagagaagcccgttgtgatgagaagattatatgaagaagttctggcacagctttcaaaggctgcggagcagtatacgcaggactcagagtatgtgaaagaactgattgcacagatggaaatggtagtggagaaaatcaactatcaggaggaaagatacgatgcccttaataaaaaattatccgatgttgaagtattaaaggaagataaggaagtcacggaaaggcttgtaaaggaaaatgaggacaaggatggaattatcagccatcagcaggatgaacttaataaggcaagcagcacgattgcaagattaagagatagcattgagcataaggacaaggagatggagcgtatgagagacaggatagaatctcttgaggataagattatgagtgcggcatctgatgatcagaaggttgcggaaaaagaggaaaaggctggaccgtcagaggttttggcagctactgataataaggaaacagtgaaaacacttgcagattcacaggcagtgccacctatgtacaatggaatacccgtgtattatcagatacctgttacggactctgccgggcgtgtaatccagcatcttccagttgagcgtacagaaagaaaatcaaatggtggtattgcggcactttttgccagactttcatttaaaaagaagtcaagagccgacattgtaaagctggttgcaagcggtgatcttgtgcctgcacagcttgtccagataaaaagtgccatagaaaagggactgacagaagggcagcttgtggaacttatcaataataatgtctcagcagaaaagatgaaagagattattgagattgccgtgcttgaaaacagtatggcaggttaggaggtacttatgaatttagcagtagtcaatgaggcggtaacagggatgaacggtgtagaacacgagttcacggaagaagaaaaaaactttgtggtgcagtttgctttccgaagcggcagtaaggaagatacgatttccctgatcgaagctctggcacattccacggataaggtacagtccgaggagattatggtcacatacaggtcaaagtacgatataaagcctgcgtgggtggaacaggtcgaaaacctgcttgtggcacttgagatgtaccggatagaggaggaaaaagcaatcagtcatctgtctgatattttaacagcatatggtattgatgtttcagcagaggaaatccgcagtacaaaggcggaagaaataaggacaacaataagagagaaagcggaggtgcgataatggcagaggaaattcaggaagcggtacagattatccgtgtcgcatatgacgggatagagattgctatgaaagtaggcagtggcggtattgccgccatgcagaaggcaatcgactttttaaaggggatgcttgattatgaaaagtcgttgggaaaaacatctatgagaaagctgctcttaaagggcggggatttgcaggtattgcagtttaaaacggaagatatgagaaaggttgagagaatggcaaagaaatacggaatcctgtattcggttcttccagactgtaacaagacagacggtatgagtgaggtcatctttcatacagaggcagttccccgtgtgaatatgatgatacagaagctgaaatttggcaggattgccacctttgatgactatctgaagaatggagatgaaaagtccctcggcaagctgatggattttttgagaaaacagcagggaaacgagaaaagccacacggtagaaggggataaggtaaattctgccatagacggactcattgaaaaagtgggaatgtttgctatggaaaaacaggctatcagtgtggagcaggtcaaggagaatttcagcatcaatggggagcaggcagaaaatgtaataaaacagcttgagacaatcggggtgcttggcggcaggagtgaggatggtacacacaaggtaatgatggataaggaggctttcactaaccggatcagagggtatcagagccttgcggacagaatgagggcaatatctgcctcaaaaaatacgaacctgtcagatgttacgatcagtaagaaacttattgcagaagaaaacgaccatgcagtaaagaccagagttccgggaacatggggaaaagatgtcagatatgtgtggctgcataaggagaacgttatggatatccataatggaaagacaatgctcacattccttgataccagcaaggattacaaactctatgatgagcagaaccgtgtggtaactacgaaaaagggagacgaactttatacgcattatgataaggtagaatcatctgtcagggagcgatatgaaaaggttcagaaagaacagaaaaagaccacaaagaagaaaacggttactaccagaaaagagaggtaggagcctatgcagacaacgaagaaaaaaccgtcactgatatttattttagtgggtgcagtgttatccgggtatcttggttatctgataaatggtgcatggacagaagggattgcctttaatgactttatgaacaggttcaatgaagtgtgtgcagttccttttgccaattattacaattcaaatacagtaaacgcagtagccattgcattatgtatctatgcaatggctattattatgtattacaccagccagagaaactatatgcccggcaaagaatatggtacagcaagatttgaaaatccgaagcaggtcaataagatactggcggataaagatgagaatttcaaccggatactcagtcagaatgtgaagatgtcgctggatttccgaaggctgaagctcaacggaaatatacttatctgcggcggttccggagcaggaaagacattttatgaagtaaaaccgaatcttatgcagatgccacatagctgttcgtttatctgtactgatccgaaaggagagatattaagaagctgcgggcagatgttaaaggataacgggtacaatgtaaaagtcatcaatcttttggagatggataaatcagactgttacaatccattttcctatatcagagaggaaactgatgtggtgaagctgattaccaatcttatcagtaataccacaccaaaaggctcaacgccgagtgatccgttctgggagaaagcagaaggcttgtttttacaggcaattttctattatgtgtggctggaggtgcagcctgcaaagcgaaactttgagacagttttgaagctgcttggagaagcagaggttaaggaaccgggaaaggcttcaaagctggatgtccgtatgaagtttctggaggagagttcgccgcttggagcaaatcaccctgcggtcaaacagtacaacaaatgtatgagaggtgcgggcgatacagttcgttctattattatcagtgcaaactcaagacttgcatttcttgaaaataagcaggttttacgactgctctccaaagatgagttaaatttgtctgatatcggtattggagtaaatggagatggggagacaaagacagcactgttttgtgtaatcccggatagtgataaatcctataacttcattatcggtatgttatacacacagatatttcaggaattgtactatcaggcagactttaactgtggtggcagactgccgatccatgtaacctttatgttagacgaatttgcgaatgtcgcattgccagatgacttctgttcgttgttatcgacaatgcgaagcagggagatttcaagtattatcatcattcagaatttcgcccagctaaaggcacttttcaaagatacttgggaaacaatccccggcaactgcgatactttcatctatcttggaggcaatgagcagagtacacacaagtatgtctcggagcttttgggcaaggggacaattgataaaaaatcaagcggtgagacaaagggcagacagggaagctcatcaagaaattatgatgttttaggcagggaactgtttacacccgatgaggtcagaaagctggataataagaaatgtattatttttatccgtggttttgatcccataatggacaataagtatattccattccgacacccgatgtttaatcagacagcggacggaaaaggaaaagcgtatgttcataatacacagggagcagaccgtatcatcggaccaccatttgagattttatcggaaaaagccgttaagcattatgaaaaaatgaaggataagggagagaatgtgtatattgatacactgacctatgagcagtttatgatgcttggagatgcggaactgaacagaagattttcaatgcaggatgaggcagagcaaaaagcaaaaattgacagggagcaggcaaatgagcttgaatatgccgatgaatcgcagaaagaggaggactcagacaacagtggaggagaacagccggtaagaaatcctgagagggagaagccgaagtgggaggatacgatcacaaaccgaatgatgcactggtcatacaccgcagagcagaaagaggaagtgaagaaagcacttgcggcaggtgttccgaaagcaacgattcttacttatttctatccggaagtgacggtggagaagatgagttcatatcggaagaatcagtaaaggcgtcgcataggcacaggaactgtggtataatgtgcctatgcggaatgaaagagtttcgtaaattgggaattgtatggtggtactttaatggaaaagaaagattttttgtatacagtgattctaacaacaacagtatttgcagctcttataacatcgatagcgaatataataatttctttgataaatagttatagattaaaacatattgaagaacaaaaaaagttaaatgaaattgataaatatcgatatagcaggttgcatgaaatactaataaattggcataaatatgattctgaaatcaaaggagaaacagacagtgaaatagcattttatagattgcttaatcaatttatggacgatttggggcgttatgaaattgcaaaaccgttactcgatgcgggctatactgaagaattggaaaacaaaaaaatagaatgtgaaaatttactaaataatttagttgaagctgaggcaccagatggtacacatacaaaggattttccaatcataagagaaaaatattttgcaagtggacaagagttctcgaaattattaaaaaatgccattaatagtcaacttgaatcattattaagaaaaagcaatatatgataattatagctttgtcattcttgtaaatgacttaatatttaattcacacagcactttagccaattatggttaaggtgctttttttgtaccttgaaaggaggtggtcacagcaaaacatatcggggaaagcccgattttatcattacaacaggctatgcctgatcatataaagtaacttttaacagccagttagggataaaccctgctggctatttttttatcgaaaaggagacaaccaatatgagaaaagaacagattattacgacaaccaacaacaatcagatggaggaaaaaggtatgaagcagagatttattcagtttaagaaaaaatttgttccggcattatccggagccgttatgggagtaatgcttatgagcactacctgctttgcggcaggaggtacttcggcagtaacacagccgcttgagaacttaaaaacgcttgtgatcgcagttatcggtgcagttggagtaattatccttgcaaagaatgtaatggaatttgcacaggcataccagcagcaggattcatctactatgaactcagctttaaagggggttgtggcaggtattatcatggcaggtatttctactgtactcactttcttaggcttctaagatagggaaaaaataatccctgttgcaatagaagaaaagaggtgaataacaggtatggatatttttaagctgggagacaaaatacttgctctccttgaagctatgtttggattttggaacaatcagatatctttggtttttgcaatgcttggacaatcgcccgtcagttttaagggcggtggtccgtgggcagtcatcgagggaatagagccaatctttgtagcggttggttcttcccttgtggtactgttctttgttatcggtttctgttcggaaagtatagatgtgaaagatgaaatgaggtttgaatcaatcctgcgtatgcttatccgattaggacttgcagaatggtttgttgccaataatgtcacgattatgaaagcattttttacttccatcggaaatctggtagggcttatttcggcaggaacaacaacacagcttgccattgacagtgcacaggcagatgttattaagggacttggatttggtgaaagtctggtaatgctgatccttacggcactgcttgcaatcatcattattatctgtggtttctttatcatttacaccgtgtatttcagattcttaaaaatattgatcattgtgccgcttggagcaatcgcctgctctacaatggcaggaaacagaatggtaagtcatacgatgtcaacttactgtaagtatttcttatcctgtgtgtttgaggcggtaacaatggcacttgcgattgtggtatgcaatgcatttatcaatgcagggctgccttcctttacgggaagttatgcagactgggcacagacacttatttatctgtgtgaaatgacatttaccatagcaatgacggttggaagtgtgaagggagcacagacacttacaagtaaggcattcggattatagaaggaggcatttatggataatgaaaagaaacaggtgacttataattccagtttttccggggagacacaggtaacactcgatattcagcagtatatgaataacaaggcaatgtatatcgggcttatgtgtaatgaagatggatacgatgagccgtttggtgatgtgaccgtaaatttgtctgttgctgcaccgaattactgcggatatctgaatgtgaatgatatgccggatattgagaaattcatcacagaaaatgagcttggggagtttacaggatttacacagaggagtggttattgtgaatatcctctttatctgttcaatgtcgataagctgagagaactgtgtccggatggaatggatatgtatgaggcaaatatcggtatggcaagaaagccggagacaaaggagttagcaagatagggggcagaggacaatggttattgaaataaacaaagatattgaccgttatcaggaatcggtggcaatgggacttacagcaaaacagcttgtattttctattgccagtgtgatagtcggtggcggtatcgtattacttctttatagatatattggtcttacgggttctgcttatgtggcgattccgtgtgtagctccgatagcacttggaggattttattcttttaatggaatgaatttctacgagtatatgggaaagaaactgcattttatgtttggaaataaggctcttacctatgtatctactgagggagagccgattatcaaggcttttgaaatggagcagaacggacaggtaaagaagaaaggtaaaaaaactcaatcagagattacaacatctgagtcagcagtaaagaaacaggaggaatttgaagaaatgaagaaaaagacaagaaacatgatgtttggactggcagccgtgtttgtgctggcggtagcgggtgtggctgcttataaagcaatgcactaaaaaggaacctgcataaaaacagattccttaaatgagggaaaatccctgtcgaagaatggaagtccagttacttttctgatagagaaatcggactataattacagtctgcttttcttcatcaatcgtataaaaggcaaggtaattattgattatcacaaaacgaatgccccagcttgccagtaccggatcatctaccagacggaacttctgtggcaggtcggctaatgagcctatctgctcagtcgcagcatctaacagattatctgcggcatcaggatttttgagggtaaattcgatgtaatccgcagcacgcataatatcgtgttctgcggtggaagtgatatgaacctgatggctcatcggctgcgtcggctcctgatatcagccatagcttcggaaaatggtctggtgttgcctgtggcaatatcgtccattccttccttgatctggctgtaaagttcaaagcggctggtcagttcttcgtaggcttcaatgctcataacggcaaggtcgccttttccattcttcgtgatgaaaactggttcaggataattatgacaaaatgtagaaatttcattgtaattattccttaaatcagcacttgatttgattgctggcataaaaacacctccttgtttgataacgaaattatacacaaattttgttatgaagtcaatggatataccattagtgttagcaggataaacacaactattcatatgtatctgaccgtgaggtcgggaacaagcccgttgggtgatgttcccggcgggctttcacagataagaaagcgaggttagagacaatgggtttatttacggacggatttaagctcttgaaaaaggcaagtgagcctttgtataagacaccgaaatccattcaggaaaccatagagattatggcggtggctgaaaacggtatttttgaagtaagcaggaataagtattccaagtgttaccgctttcaggacatcaattacacaacggcaacggaggatgagcagatcggcatttttgaaagatactgcaaattcttaaattcgctggactgtaattataagattacgattaacaataagaacaaaaatatggaggatctccgtgataaggttcttattacagaaaaaaacgatggcttcaataattaccgaagaatttacaatgacattattgaggagaagattattgagggcagacaggggattgaacaggaaagatacctgacgatcacgattgagagaaagaactttgaggaggcaaaggcacagtttgccacacttgaggcaacaatacacaaggctttcattgaactgggggcggagattgtgccgcttaacggcaatgaaaggctgaaagtgctctatgactattaccatcttggcgatgagggcagttttgattttgatatcaaaaaggcaaagaaggtcggagcagattttaagaatgatttatgtaatggtatggtgaaatatttcccagaccattttgaggacgagagtaaatactgcaaggcacttttcattaagaagtatcccagcagtttatctgacagatttatcaatgagattacttcccttcctgtccactccattaccagtattgatgtagtgcctgtgccaaaggatttgaccacaaaggtgcttcagaagaaatatcttggtattgagtcggatattatcaagcagcagagagtccgtaataagaacaatgacttctccacagaaatctcttatgcaaagagaacggagaaaaaagagattgaggcaattatggatgatgtccgtgagaatgaccagtgtcttttctttgtaggagttaccattatccttatggcagaaagtaagaaggagcttgagagtgtctgcgaaacagtagaaacaatcggaaagcgtaacagttgtacgattgatacacactacttaaagcagagggaagcactcaacacggcacttccgattggtgtaagacaggtggaaacaatgcgtacccttcttacccagtcgcttgcggtgcttatgccgtttaatgtgcaggaactgaatgacagcacaggtaattattacggtatcaaccagatcagtaagaatgtaaatatcggtaacagaaagaagctcatcaacggaaatggctttgtattcggagtgccgggttccggcaaatcattcttctgtaagatggaaatgggcagcgtattcttgtcgggagatgatgagattatcgtcattgatccgatgaacgaatattttgatattgcacagacttatggtggaaccgtggtaaatatgtccatatacacggacaattatgtaaatccgcttgagatggatgtgtggagtcttgatccgaatgattcaaagggaatgataagggaaaaaggggaatttatgcttggtctttgtgagcagtgtatcggggacagcttaaattccagacagaaatcaatcattgaccgctgcgtgagaaagatgtatatcgacattgcaaggggcagggaaaagtatattccggtaatgagtgacttctacgatatccttatggaacagccggaggacgaagcaaaggatatcgcattgtctttggaactttttgtaaatggttccctcaatatctttaaccaccagacaaatgttgatgtagataaccgattcacggtatatggtatcagggacttaggcacggagcttagtcctatcacaatgcttgttatgatggagtctattcaaaacagaattgtagaaaacgggcagaagggcaaggcaacctggctctatattgatgagttccatgtcctgcttaattcggagtattctgcaaaatatttacagcagctctggaagaaggtgaggaaacaaggtggactgtgcacgggtatcacccagaacgtcgtggaccttttacagaactacaccgccactacaatgcttgcaaactctgagtttgttgcactcttaaagcaggcgaatacagacagttccaagatggcagaggttatcggtgtatcagaggcacagcttcgtttcgtaaccaatactgcatcgggaatgggacttatcaagtgtggttccgtggtaattccgtttgataaccagatcagcaaggacactgacctttacagactgtataacaccaatatccacgaaaagattgcggagcagaagaaaagggaggcaaaatttgctgattagaattgcaatgtatcagccatttggactaagttccggatggctacttttttaccttttttaaggatacagaaagaaggtgggaacattgaagataaaaaaagtggatgacaagcctatggtcattcacactaagaaaaaagctaagattcatatgcatgaaccgaagaaggctaaaattaagggcagtaacatttacaccgtacagcgtggtccgaaaattgccagtgcaaagataaatgatacaggtaaaaagaagtcttatcgtaagagtaccattcatcaggcagagaagaaagaaaaggaaccttcaaaatttaagagaaatatacgggagtccaatacttctatcaagacgaagaataccaatcttcatatagcaggaagaacgggagcacttgcggctggagcagttacagagcaggtggaaggcgggcaggaagtgtcacaggcagcttatcttgcatatgaagtaagccgtccggttacgggaactgcttcaaggggagcgtcacttttcagaaagaaagcggcagccgaagcaaagaggcgtatcaagaaggtagaaacaggaaagaaactggcaaaaaagatgggaaagaaagctgccagtgatacggcaaaaaaggttgccggtgacacgacaaagacagcagcgaaagaaactgctaagaacactgcaaaagaaactgccaaaactacggcaaaagcggcaaccacagcggcaggtacagcggttgcaccgggagcaggtacagcagtcggcatggcggcaggctatgccacaggtgtatctattgaggcgaaggatgtgaaagcagcgaaccgtagcagaaagattaaattttttctggataagatgaaagaacaggaaaatcagacggacagtgttgtaaaactggtaaaagatctgattgtaaaaaaggcagttctctggataaaggcggcagctccgattatcggacttgtacttttgctgttggttcttttagtggtaatcgttgcagttccggttattgctgtgatagcgattctttataattcaccatttgccttatttttaccgccgctggagtcaggagatacagtgcagacagttacaagtgcttatgtgtctgaatttaaccgtgatgtgaataccaaagtgaatgaacataccggatatgactttggcgaactggtgtatgtagattatgagggaatggatgaaaatccaagtaactactacgacattatggcggtctacatggtcaagtatggtgtaggcgatactgcaacaattatgaatgatatatcaaaggggtggttgcagactgtagtaaatgatatgtgttcttatactacaagtagtggaacaaaagatgtggaggaaacagacgcagatggcaatgtaacaactgttacgaagtcggtactgtatgtaaatgttacgctcaaatcatacagagatatgatttctgtttatggatttaattctgatcaggtagaaatgcttgagcagatcatgagtccggagtttatgggacagcttggatatgccggaagtggaagcggtggaggcggtggaagccccggagtaagttccatgacagaggatgaaataaatgcaatcctcagtggtattacagatagcaggcagaaagcagtctgctcttatgcccttcacagagtgggttatccttacagtcaggaattaagagatagtggcaattattatgattgcagttcacttgcgtattattcatggaaggatgcagatgtgaatatcagttatggaggagcaactacagcagcggcagaagcacagggacttgatgaagcaggaaagaccgtatcttatgatgaaatgcagcctggtgatcttatcttttacagtttcacaaacaacggaagatataagaatatcagccatgtggcagtatatgtcggcaatggcaaggtggtagaagccctgaatgaaagagttggcgtagtttaccgtgatgtggcaagtgttggaaagattgtagtaattggcagaccatagaaaattggcagagagggcgaaagtcctctctgggacaggaggtaagaatggatttaaaggatatgattcttgtaatggagaattataagggaacagaaagaaatatgcttatgactttggaagattataagaagttcgttgccattgatgatatgtcagagcttgcagatcagatgctgcttcttggaagaacgcttgcggaaggttttacagagtattacagggcagcaaatgttacagtttttgcaaaattctgtagagatgatgtggaactgggacgctttttgcaaggatattataatgattcaaagaaattttactttgataaggcaacaagttccccagagtgtattacaaagatggatgagattggaatgacggatagaggctggatagatgactttatcctgcattatgaaaaatgcgacaggacatttgaaagagggcagacatttcataattttaatgaccacgattatatggtacttgaagcattatctccacgcaatcttgtggtaatggatatgaaaagcggctctctcacgattgctcttggagcaacagagtataagcgatatccgaaagacgaggagccaactaaggataacacagcgattggggtatcgtgggagcacgggatttatcttggttccacactttcgcagaccaactttaaggcatataaaagagaatacgggacacctgaaaagataaaagatgtttatgattacagggcgaaactcaagcagaagttttatttttatcaggatttgtcaaaggatgatgatattccaaaaaatatgcagaatgatttcctgcaccagatgtataaggaatttggaacgatagaggaggaatatttttatgacaggcttgaagatggaaagtatgatgaaggttttaaggaaagacaggtaaaagaaaaaaagagccgatgaggaaaaatggaattggaggctgatatcgaatggaaaaagaatttgatattgagataaaagaagttctctcaagggtagagacagtaaaggcagagtcacttgacgatgccataaacaaggcaatggatatgtattattcagaacagatagtccttgatgcggaggatatgaagggagttgatttttcgccatacagcgaagaacagctcccttcttcattaaaggaaaatggaggaaagacacgatgaaaaatgagcagacagcagttattaaggatatggaatttttattaaacgaacttcataaggaatgggaaagaccgggagaggtaaaatcgtctgtcagtattccatatgagaaagttgaggaaatcagcagaaagctgaatgtgattgtctatgagacacagcagtcggctgacagcgacggacttgcctttaagcagagcatagccaagtcaaagcagtgttatgtgcttctcaggattatgcgaaagattgtaaaaggaaagggcaaatgtgatggacaggcggttgatgcagaatttgtgattgagcttgacggggaggagtcaaagctctttaaggaaatgtttgcagaattactgaagtaaaaggagggtgacacatgagtgttgatatgaaggtcaaagcgatatatgattcagaaatcagcaacatcacccgttctgaaaagaactggaaagatgtattaaaagttgctggtcagttatatcgctatgaatttgataatatcgttatggtaacagctcagagatcaccggagaaaagtacccttatggcagattatgacacttggaagaaagtgggaagatatgtaaagcgtggagcaaagggctgtgctatcttcccctcaagggcacttaatccccgtatgagatatattttcgatatcagtgatacaggcggaaagaatgtgaagctgacttgggatctggagggggaaaacctgaaaagttatgcagactttctggtatcggaaggacagatggagcggtataaaagcgatgacagggaatcactaaaaaatacgctaaaacagtttacaggaacaaatgtttggaatataataaaagaggagttcggggatagaatgtccgaactaatgcagctatcaggtagtgtgataaaggaattcaacgaaaaacgcaagggcttacagcaggatagcgatatggagcagttagtatattccagtgttatgtatgctgtagggacgagatgtggatttgacttatctgtgcaagaacaggatttcagtcagattgtaaatatcaaagatgaggagatagtttaccgtcttggttcccttgtatgcgatgtctcctgtagtgttcttagagaatttagtaggaatttacaaacgattgagagcgaaaggagaatatcatatgttagaagcaatgacttacaaggaagtggacggactgctgtatccggagctgacaatgccggacgagacagaggatttaacgaagctgggcagatacgggagaatggcaatgaagtatcttctggagaacgaaccggcaaggtacaagacactgatgagattcgggaagatgtacgagaagatgtcggcagtagaggaggaagcaaaccagctttacgatcagttggaggaacagtatctaatgaagcacaagccacagaatccgtcatcgacaatggagatgtggaagataagagagcaggcgaagatgcaggcagaggaagtagtgctccaccagatcgtgatgaagtttcattagaaacacaggaagaattaaatagagagcttgatgagattaactcattgggtgtcagtaaggaagccgaatatacacaggcttccttttttttcgaccaaaacgggcaggcaagttttggtgtgaagcagccggagaaaaccagacacaatgaatttatgcgtcagttcgaggaggataaaaaggctgcccttgccagaaaatataattaccttaatccaaagaaagcagagagtgtaccaagtgagtatgtaaaagagatacttatgaaaggaactggctttgtcggtggaaaaggcagggtgtgtgaaatctatcagacagagatagacgcaggaaccagagcaaagcgtatcaaggcagaatatggtcaggggggtgcaagctggccgcttgacggtctaggcttgcacgggtatgacacatttcacggttcgggacttcgtatccaatggaaagatgaagatggagaagtagaaggatacgtttcgtggaagaatgtcgaaaaggaaatcggtgtacttatccttaccggagaataccagtcggagacacctcgtattgatgagcttgcaatggacggacttcgtgaagatgatgaagtcattgacgcagagtaccgtgaagttgatacgcaggaggagaaatcagaaattgatgattatgctattcctgatgagcctgacagttatgctgtaaacagaaaggcggctgagttacggtatatcaagccgattgattatgctgaccgtgtagctgcaatggataaagatttaagagatgccattgagatacttgtgtcagaatgtagctgttacacaccattccgtgctttccttatggatgtggtgcaatcggattttgcatttatgccgaataagctggaactgatctgtgagatagcgatgggaaatgttcagggtgagagaaaggcatattgcaataatcagtatggactcacagaatacactttaagcagtgcagatgtgaaagtaagctacaaaaacagaaatggagagagggcaggggataccgtatcatggcgtgaggtatatgaaatcttatcctatatggtaaaacagccattgtactgtggagaggaccagaaggcaatctatcagaccataaaaaataagattgacagggaaaagatgaatcctgtttatcgcaagttctttgatattgaggacagtgtgagagaaagccgtcttaaaaccagagaacgggcgattgcatatggcttgaataccaagattgacacggatggtcgtataatttctgatgaggataagaatgtatcggcagatattccacagaaggataccgaaccacaggaggctgcccctgaaacacctgcacaggaagtattaccgccagtggaaggtctgcgtggaaaagaaaaaacacaagaccagacaaaactcaatttccactataacctgtgggaaacagaaaagggcggtgcaaagaccagataccagtggaacattgacgcaatccgtacactaaagcagattgaagcagaaaacagacttgccagaccaaaggagcagacagttttatcaaagtttgtcggctggggtggcttgtcacaggcatttgatgagaataatgctgcgtggagcaaagagtatgcagaactgaaagagcttctttccgatgaggaatacagtgcggcaagagcaactgtaaataatgccttttacacttcgccggagattgcaacgtgtatcaattcagcccttgtgcagtttgggtttaaaggcggaaatgtcttggagccgtctatgggtatcggtaatttcttcggaagtatgccagcaccaatgcagcaaagcaggctgtacggagtggagctggacagcatatcgggaagaatagcaaaacagctttaccagaatgccaatatcagtattacaggatttgaaaacaccacatatccggataacttctttgatgttgttatgggaaatgtgccatttggagattataagatattcgatccaaagtacaacaagtataacttccgtattcacgattattttctggcaaaagcactcgatcaggcaagaccgggaggtatggttgcagtgattaccacaaagggaacactggataagagcaatccgactatacgaaagtatctggctgagagggcagaacttgtgggagcaatccgacttccgaatactgcatttaaggataatgcaggaactgaggtgactgcggacattctttttttacagaaaagagagcgaaaaattgatatagagcctgactgggtacatcttggtgtcacaggtgatggcatagcagtcaattcctattttgcagagcacccggagatgatgcttggtacaatgcagtatgatacaaggatgttcggacaggacagcaaatataccgtctgtgtgaataatgatgagaacttcaatctgtatgaagcactcaatatggcaatcagtaacatcaaagcacagatgacagattttgagagactggcagagaatgaggaacagacagaggaagtcattcccgctgatccggatgtcagaaattatacttacacattctttgaaggaaaactttactacagggaaaattcagagatggtaaggcagaaagtatcaccgacagcggaggggcgtattaagagccttgatgaaatcagacagataacaagagagctgattgatatccagatggagggctgtagtgatgaggagcttgcagacaaacagcagcttttgaatgtaaaatatgataaattcgttggaaagtatggagcaatcacttccaaagcaaaccgtacagcgttcagggatgacagcgattatccgcttctttgcagtcttgaagaagtaaatgaggacggggaggtgaagaaggctgatatgttttataagcagacgattaaagcaaagtccgtggtggacagggtagaaactgcagttgaggctcttaatgtatcggtcaatgagtttggatatgtaaatattccttatatgctctccatttatgaaacagacagggatactctcataaaggaactcgatggaattatttttcttaatcctgaccgttacaatgaaaataacccggacgcaggctgggagacagcagatgaatatctgtcaggcaatgtaagggataagctgcgtgttgcaaaggcaatggcggcggataccgataatccgcaggcagaaagatttgccgccaatgccgcagccttagagaaagttcagccggaatggattgaagcctcggatatagatgtaaagattggtacaacttggattgaaccgcttgattatgaacagtttatctatgagctgcttaatacaccaaaaagggcaagggcaatcagaacggagtattataattccggtattcaggtacacttgaataaaatgagtatggaatggttcattgagaacaaaagtatggataaacattccgtggcggcaacgaaaacttatggtacaagcagaatggacgcttattctatttttgaggataccctgaacttaaaaacggtcactgtcagggacaggattgatgatggtgagggcaagtaccattatgaagtcaacaaaaatgagacaatgcttgcaagggaaaagcaaaatatgatcaaggagaagttcaaggaatggttatttgcagaaccggaacgccgacagaagtatgtggaatattataatgaaaccttcaataatatccgcctgcgtgagtatgacggaagccatttgcaatttccgggaatgaaccctgagattgaattaaaaccgcaccagaaaaatgcggtggcacgaatccttatgggaggaaatactctgcttgcccactgcgtcggagccggaaagtcgtttgaaatgatggctgcgtgtatggaacagaaaaggctcggactttccaataagacaattatggtagtgccaaagccgcttatcgggcagacagcaagtgaatttttaaggctttacccgtcagcaaacatcttggttgcaacggagcgtgattttgaaaagagccgaagaaagcagtttgtatcaaggattgcgacaggcgattatgactgcatcattatgtcgcactcgcaatttgagaaaattccaatttcggcagagagaaaggagcgaatgcttaatgaacagataaatgagatcacctatgcgattgatgatatgaaggagcggaacggggaacgctggaccgtaaagcagatggaaagccagaagaaaaagctggaggaacagcttaaatccctgaccgatgagagcaggaaagatgacctcattacctttgaggagctgggtgttgactctattatggtagacgaagcacacaattttaagaaccttgccattttttcaaagatgaataatgtgtcgggaatcagcagtagtggggctaagaagtcaacggatatgcagcttaaatgccagtatttatcagagataaatgatggcaggggcattgtatttgctaccggaacaccgataagcaacacgatgtgtgagatgtatgttatgcagctttatttgcagaaatcggcacttgaggagatgggaattcatcatttcgactcgtgggcggctaactttggagaagtaacaacggcactggagcttacggttgagggcagtggtttccgtttcaagagcaggttcaataagtttaccaatctgccggagcttatgaacatcttccgtgaggttgccgatgtgcagacagcggatatgcttgaccttgatgtgccagctctgcgtggcggcaagcctatcatcgtggagtcggagccggactggtatgtgaagcaggtaatggaagaatttgttgtaagagcagaaaggataaggggcgggggtgttgatccaagtgttgacaacttcttaaagattacgcacgaagcaagacttcttggaacagacgcaagactgattgataaggacgcaccgaacaacccggacggaaagctcaataaggtagcggaaaatgtctggaaagaatatgtaaaaggaaatgctgatggtcatataggctgtcagcttattttttcagatattggaacaccgggaccggacaaggactttacgatttatgattatctgaaggagtcacttatcaagtatggtatccctgcggaggagatagcatttattcacgatgcaaaaacagacgcacagagggatgcactctttaaggaaatgaggacaggtaagaaaaaagtccttatcggttcgacagataagtgcggaaccggagttaatgtacagacacaccttgttgcaatgcaccatgtcgattgcccgtggaagccttcttctattgaacagagggaaggcagaggtatccgacagggaaataaaaacgatgaggtggcaatctaccgatatgttacaaaacaaacctttgatgcatacaactggtcacttgtggaaaacaagcagcgtttcatcagtcaggttatgacaagcaaggcagtgagccgaagctgtgaggacattgatgaggcaacactttcttatgcggagattaaggcggttgctacaggcaaccctttaatcagggaaaagatggaggttgacaatgatgtccagagattaaagctcttaaaggcgtcttatgataatcagagatacggattgcaggataattttatgatcaagtatccaaaactcatcaaaactgcgacagagaaacttgccaatgtcagggaggatataaaggcaagggataaggaattgattgataacccggattttgccattaccataggcaatgcaacttatacagagcgagtggatggtggaaccgtaatgcttgaagcaatcagcaaatgtaagacaggcgaaaccactccagtcggtaagtttcacggctttgagcttctggtggaaaagaatttcctcagtatcaactatatggtgcttcgtggaaagacggaatacaaggcagaactttccacaagtccggtgggaagtatggtaaagctggagaacctgttcaacggacttcacgaaaatgttgattttctggaaaagaagattgaacagtaccaaaatgatcttgaggcttcaaaggcggagtatgacaagccgtttgcatatagtgcagaactggaagaaaaacttgcaaggcagtatgaattaaatgcccagcttgaccttgagaatgcaaaagctatggacgcagatcttggcggactggacgaagaaaagtctgaggacagaatagaaaatgcgggtattgttgcagaggataagggaatctatatgccagacagaaacaggaaaagataggagtgaaactctatgagtataaggaaagtggtcgcaggactactgattacagcagggattgccattatggcagtcccttttttctggtgtacaaccggagagagaaacacgaaccagctcataaatgaatttgagcagacattggaggagaagcaggatgaaaggacagaggttgagaaagagcaaaccaccgttagtaaagaggagaaagccattcttaaagaaggcagtatcatcggcattattgagataccgggaatagatatcagatacccagtaatggaagaaaccggaagtgaaatgctgaatgccgggacagggaacaatgcgttttgttgtcaggtgcagatataaggaggcggcagatgaataagagataccgactgggggagatagaagaagctgtatcggaaatggaggagctgatcgacactcaggacgatattgcagagattgatgatgactttcagatagtcgtaagcggctggtctgtgtatgtcgaaagcctgaatctgacactcagacagggaatagcctgtgtatgggatgcagaggaaggattatttatgcctgattttgatgtgactatcgtgtatgaggggaacattgaaacacaggagtggctctactacgagcaggacggaatggtcgttacacttggcaactggttaaatggcagattgtcttgtgaacagatagaacagctttggtgtgagcttatcataccggagcaaaacaaagaacaaaaagaaagcgaggaatagtatatgaagtattcaattaaggtaaacgaagtaagagcaaaagagggcagcaatatcaaaggatttgcaacagtggtattcggtgattcatttaagattaccaatattgcaatccttgagaataaggacaagggagaacttttcgtatcaatgcctagataccgctccaatgagcgtgatgaaagcaatggtgtgatctataaggatgtgtgcaatcctatcacagcagagtttcgtgaggaactctataccaatatccttgatgcttatgcaagaatcaaggaaccggagaaagaggagacacagaagcaggacagaacacaggaaatgcctgagttttccgtaactgtgacaccttatgagagggaaggcagtaacatcaagggacttgcccgtatttactttgaaaacagtttcattgtaaataacatcaatatcgtgcagggcaaagagaaaatctttgtatcaatgccatcttataagacaaagcaggtggatgagcagggaaaaccaatctaccaggatgtctgctatccggtcacaaaggatttcagggaaaaactctataatgagattatctcggaatatgagaaagcaaaggataagagcaacgaaaaagcaagggagaatgccgaacagaaccacggaaatcccgacagggagaaaaaggatactccctttcgataattaaggttaaggggcggcaggagctgccccgtttataaggaggaaaagcagatggaagcagaaaagacacttaccaatgaggagatcataagggaacttcttgacctattaaaaaagaatgctatgaaagagccggcaaatgatgtatttgagatatgcacctatgtggatggtctggagaaaaagattgcgtctatgacagaagaacttaccagtatgcaggaccaaatcaagaaaatgcaggaagatacccttatcaataatgcaaaaaaagcattaacagaagcacaggagcgactcaatgccagatgtgagcagataaagtcacaggtatctgagataaaggtacaggtaaaatctactgccaagaatattgttgatgaaacaaaggcaaagggcagggcggcactttacagggtgacagaatttgtaggaattaagaaaagacttctcaatgtcagaacagtggtaaaagatacgattgtatctacagacagggatattgcaaggacagcacttcttgcaaagggattccgtgaagctggtcagaccgtaaacaatgcgttccgtacctttgcagataaaccggagatggattattcacagaaggaacagaaacaccctctcacaaaggcggcacttgcccctatgaaagcagtgagaaaattgcttgtatcaatggagctgcatctggatgcttcgattgataagctggataatctggctatgaatgtgcagcttgataaggaaaagcgtatggagcagacaaaggataaggaacagaaagcaccggatacagaaagagagatcatctattcaccgatggtagctgaaccacaggagtacaagtataatgcagatgcttttgaggcaagaaagacatcggaggcaaagcaggaaacggcggggaaggagctgccaaaagtcagagaagataaagccagataagtttaggggcgtgggagtaaaatcctgcgtcctttttatttgttttaatagcaggcaaaaaatggcgaaaatataaaaaaatgcaagaaatggcgagtaatttatcgaggaataagttatcctttgagtaagatagatggactgtggttatgtataaaattttgcaagtaataaattttatacgaaaaaaacacagaaatgggttgcatatatgcaggctgatacatataatctcgacagacagacagacagacagacagacagacagacagacagacagacagacagacagacagacagacagacagaataagtctgttttcttttggcatgatctgattgtatatggcacattttggttatgcgttagtgcataattgaaatgtgccttttatattgaaaccaccttgatgtacggtcatatattgacttgtatatatacatattgatgggacaacaaagaaccattttatccattaggaaggagacaagacaaatgtttaagaaacttaacaaaatgaagattggtgcacgactgaaaaaatctttcagacagattattctcatttttggaatattatcagcactggttgtagtgattatgctttatacgataaacaactatggaacgatactggataattatgcgtatccacagggagacattgctatggcaatgaatgaatcagcggaagtaagggctgcctcaagaggtattgtaggttatgattcagatagtctcattgaaagtatgaaagaacagcatgaacaggctgttaaatcgtttgaggaatatttggaaaaaatacgcccaacaatgataacaaaagagggaactgcctgcatggacgctattgataaagcatgggcagagtataaggaagtggatgcaaaagtaattgaggtcggtgcaacgactgatactgcgaaatcattacaggctcagcagatgatgaccgatgaagcagcaccaaagtatcaggcgttgaatgatgctttacagaaacttatggctttgaatatttcattgggaaatgctgaacgtgcacagttgagaacgattatgatagctgcattgacaattataataattgtaattgcagtatcaacgatttattcaaacagtctttctgttgcaatatcaaagagcattgaaaaaccattaaatgaattaaaggacagatttattacatttgcagagggtgacatagattctccacttccaacggttgagtctgaggatgaaattaaggaacttgtgtctggtgtatctgcaatgtcagacagaatcagagttatcattaaagattctggcagaatgttaaatgaaatgtcagatggtaattttgcgattgatacagagtgtgaggaagtatatacaggagcatttaccggtttgctgacaggcataagaaaaatgaatgaggagattgatacaactgtaagaggggtagatgatgcatcggggcaggttcttacaggttccacaaatcttgcagaagcggcacagtctttagcagaaggcgcaacggatcaggcggcatcggttgaggaaatgcaggcaactatcaatgaacttacaagcggaataaaaacaacagcagaagaattgggaacagcttacgatgaagcctataagtatgcggagattgcagaaggcagtcgtggagatatggaagtattagtgcaggctatgtcacgcataaatgaaacctctgagaagataggagcaattatcacacagattgaagatattgcaagccagacaaatcttctttcattaaatgcttagattgagacagcaagagccggagaagccggaaaaggttttgctgttgttgcggatcagatcagaaaccttgcagaacagagtgcaaaatcagcggtggattcaaaagcacttattgaagcggctattcatgaggttggagatggaaatatgtatgcagagaaagcctcaacttcattgagagaagttgtggatggcatacaggcgattgcagacagtgcgaaaaaataaaagaaatttccattgaacaggcagacagtatggaacaggtagaggtaaccgcagaaagaattgctgaagttgttcagaataattcggctgcggcacaggaaacatcagcgacaagtgaagaacttacagctcaggctactacacttagtggtatggtttcggtatttaaattaagacaataagaatagccgactggaatttagaagagatgtggaagttattttgacattatgagtggaaaaaaactgtgtaggtgtttcggtgaattgttctctgattatatcaaatgcaagaattgtcagttaaggctggaatccttaccttgactgacattccagcatttaatgctcatgtgcggtaaagtaatacacaagaatttcataggtagcagcccactattcctaaatcttttgtggaaaaaaaataaactcaaaatttacagttaattttggatattgtgcataaaaataaagatatttcaagttattggaaattatattcagtatcctgtatttacaaatgtcgatttgtgtggtattataattataaataaaagctgtttgatagtgcggttagtctggatttttgaaaggaggaaaactttatgaaaaagtttttatcagtaattgctacgatgttgacgttaacccttatgatgtcaacagtcgcttttgcagcaaatgacactgatgattcagttgtttacaatgggcggtccttcaaagcaaccgagttatcacaagaaactcttgactggttagaatggtataatggcttatctgatgatttaaaggaaatggtaagtcatgagccattggaattggcatcacctactccatgcacaaccacaacaaccgttgatgccacagctttagatattgacattcctatgccacttgaaacttcgcttcttccaacaagtggatatgagcctgtctataatcctgattattggaataaagatgaaaacattagacgggcaaattgctatgcttacgctatggacgtattaaaaacaacagaaggcaaattacagccaggcgatccatcaggtaagcgttatacgtctttaacaaaaagtgcgattgaaaaagctgttaaagctgatggtccatatttaggtagcggacgtgaaattacaaattcaagtaaaaatgcaactccgggaaagaatcaatacaaagttgccttagttatcgctcctaattctgattatcactggtatgtacaaaatagagatggctattggtcgcataaacaaggttatttaaaagtttctaatgttgatgcaagtggaaagaaaattacagaccctcaatcttgtgaccgaaattatggctcaggactaaattattccacattttgcggatattatttagtaaaatatactaatagatgatgaaaagatatgttagtatatttatagtattgattgttttggtgataggagtgtttttcgtacatcaatcatctacttcccatttatcaatggatattgtcaattctataattaaatcaaaaggtattaacaacgtcacatgggaagattttgaaaaatatacctatcaagatataggaagtgggaattatatttatcaatacgagttaccgaacggcttttatttgtatttaagcggatcagctttagatactccccctacatatatttacatagtagataggaatggaaatcggatcgatttaaagaaatgattttcaatgatggttttagggctaaagagggtattctaaaaccatcatttttaatttgatatgtacgttgttttgaaaagggcgattccaatgtatttataggatttgcttgttaaaaaaactaaattagaaatgaggtacaattatgaaatttaaaaaaattatttctggtatattatctttaacacttatattaggagtttgtagtatatctgcttttgcagcagaaaataccagtgggtgctatgttgtcactgaagaaactcctgaagaaattcttgaatatgcaaaagaggagttccccgaatttctctcccatcatttaagttctaacggaattaatgcgggagaagcacaatatactttgggctatcctattaatattcaagaatctgatggtactaaccgaatttacgattttcctgttatggaaaatggtgaaatttttgcaatgctcaccatctatgacgaaaatggtgaatattacacacagcttgacgaaaatttaatggctgaaaagttaaatgaattacagaatgtaagctctcaaagttctcctattagtctagtttccaataatgctggattttttgcagtagtaaatgattttgtagagccacttacaccggatagtgaaattgaaaataccgtttctttgatgaatgaaagtattactggtaatattgttaatattacaaatgtactttcagaaacagatggaaatagtatttcccttatggaatcaagcaatcctagtccgttaggcgttgtatgcgttcctcaaacagatgacgggacttttaatggtacacagaaagaatggtgcggtgctgcggttactgctgcgattattaactacaaaaagggaacttctttaacagcaaaaggtgttacaaaagaagcgttaggctctgctaaaaatgaaggactaactaattcagaagttatttctgttgcaaaaaatcatgggttatctcccaagtctggaaaccctctaagctattcatcagttaagacagaaatcaatggttatcgcccaatatatatgcaaatgcagcggaaatctgatgaaggaaaaaaataccacgctttaactctaattggatatagttcttcaaaatatactgtattaaatccgtggcaaagtagtagcataacccttaccaaaaaagatagcggtagtgatgtcacctatgtaacaggaacaagaacatataaatggtataccagcatttataactggaaataagatgttgctggggaagtgagaaaaaatcacttcccctaatatctgtttttgcggcaggctatctagcgggcgactatccgccacgttatccatgtgtccgctattaatgatgaattgcttgccgctgtcggctggttagcagccgagtacgggcggatcagcggcaatcttaatcagatagcccggtatctgaacgagtacggcgcaccaaaaatcattgattattcttaaacggacaaatttaaagtgaaataaaatttttattaaaaattcttttgtactaatgtcaaatatgcgttactgttattttttattatggacagcttattttttttaactaagtatctaattctataaataatataataatcatctatacatgccaaataatgttctgaaagattctgaattattttattgattgtcgtaatcttattttcacaaaatacgcctaatataatatcatcaaaaaagttatcatgtattcttacaatgcttccattgatatagcttctcaaattccagttagaattaatatttttattccaactatttatgcattcgtttagttcatatcgtgttaattttttcgcttccttcaataaaccaagcataatttctgcctccacttgtgtccaagaaaaaatattgccatagcctccaacacatacatttatatccatcacataaatattaacattacaatttttaagttcattacaaacacaatataatcccaataaggaagaaggtaagttatccacccatattctgaatgcatttttttcgttcgcaagcctttttatttttttaaatctatttagattatcaatatatgaataatgttcataatatatttcttcaatgaatttcttcctacaattgctatccaaacaacaatttatgggtcctttatcaagatataattgcaaacacaatatatcattcaatgctacatcacttgcctgtcctttttcgttcatatatgtaattattttttctggttctcttttacattgtcgcataatgactcgtaaattagctgcaattccttcatcaaaaacaatctcaatcattttaatctccaatcaaaataatgtctataaaatcccacctatattaattatataggtgggcaaaataatgtgcaaactatactgttattaagttcatgagttttctataatctgacttgttaattcgcaatcacagaatgcaacaatccaattggataacaaaattaagtttttactttataggattagtaagtttcttttctggaattgagtagcttgtgtctccatttaccgaaaaactggatttaacatatacatatggattattcggtgtacttccagcataataatactgtttagcatcacttacagtagtttttctcaaatagcttgcatgagatgctgaaacagcagataaatatgatgaattatttttaggctttacagataaactatgatatgtaaaatagtcgcttttatctattacagttgcggtcatctgtacctcatagtaatgattaactccttttaacccatcatcaaaaaacatatagcctcctacaataacatcctcaaccagcttatatgtttctgtctcaccagatattatggtcatctctccattcttatctattgcaaaataaatggtttcaataggggttctttcatcactaaattcttctgcattttccttaacatatgctgccactgtatctatagccgcattttcttcagatggcattgcataagcgtaattaggaatggtagttattccaagcatcatggctaatgataaaatagctattattttcttaattttcttcatataattgtaattctccttccactaatgaacaaatttcaatatatatgcacattatttggaaaataatagcatacagaaatataaatttacactctctatgcacgaaatacgcatttattgcacgaagtataattcttttgattttatcgagcaggaaactaagattttttatattaagaaaaacgttatgctttaatgtctttaatgcatctttatgcttttcgtgcaaaaaaatcttacttcgtgcagaaaaggtgaaatattataagatgcttgtcgatataaaagaaaaataaaaaggtttttatatgaaaaagcttaatgatatagctatgaaattacttgcaaaaaagtaaaatttatgtggcttttgccattttacaaatatccaaaatataccgattgcaaataatattgcaacagcggattttatgattcattccacgcttatgaatgaacagtattcacatcagattgaaaattttaaaaatacagtggatgtcagagtaaaagaaatgcagtgatggatatgataaatagccaaaaactgtccgctaatagaatttacaacagaatatagagcagataaagacgaatggtatcagatgtgccattcgtttttttaataaaagcacaaattaacctacttacgagcataaaatgatgtgcgttgggttgttttctggactatgagaatcaaagtcccattgatatgattaacatggaaaagaggtgcaaaatcttggacacaggaagaaaagatgccaatatacagataggaaagagactaagagaggcaagactgaatatgaacctcgaaaagtcagaaattgcggatgtattggatgttacagtagaacattatcgaaagcttgaggcgggtataacgggaatatctgtagataaagtgttgacactctatcataaatatggaattgatcctacatatctgataacaggtgagagcagtatgaaagattttaatctggattactatgttgcgaacagcacaaaggagcagagaaatgatttttttgaccgtgtgctggcttatttatctaagttgattagataaattgaagtgcttcctacttccaagcccgaaaaggaggaagtgttatgcttaatattgcggtctgtgatgacagcagaacagatgtagaaatgctggaaagtgcttttgataagttagtgcagtaccagttttcttatgaagtgtattttacagcgaaggagttgctgaagcatgttatagatgatggggaaatgtatcatctgtatatatttgacattgaaatgccggagatgaatggtttgcagcttgcaaaagaaatccggaaaatagatgccaaagcattgtttgtattcctgactggatatacgcagtatgttatggatgtttttgaggttattacctttgactatatttctaaaccgattacagtggaaaagctggagtccgtccttttaaaagccatgcagtatcttcatatgataaagcgtgactttgtctttcagttccgaaaaaatcagtttcgtattagctgcgatgatattgtgtattttgagaagaaaggtcgtcaggcagtgatacatacgatctcagaaaatttcaaggcaaatatgacaactgaagaaatatggaaacagcttgatgataaggtctttgcccatattcatgtatcatatatcatcaatcttgggcatatcagggcgattgagggagatgaagtagtgatggacaatgaagaaagacttctgattgctcgttcccataagcagaatttaaaagaaaaacatatggagtttgtaaggaggatggtttaaggatggaatatgtgatacgctttgccatcagcctgtttgatctggcagtgtttatgtattattttcattccaataagaaaatgaaaccagtatcaaaggtatggatatgggctggatttaccattgctgcaattatatggacatttgtcagcaacataaaaaatccgtatctgaatcttgcgactcttttgattgtgcttatactgttatcattttattatgaatcaggaatgtggacgagaattataaatattgtgacattcatgggtattggaatgctgtttgaacctgtagccttgctgttactccatgcgatgaattttcatgtgggcgaaagttataaatattattttgtaatggtaatatgcagctttgttcgtggaaatgtgatgtatattctgtcaaaattgatttcaaagaaagggatgcagattgccgactttccaagagaaattttgggtgtgctggttatggtatttacctttacggtgttgaattgttgctttgttattcttttgtcattggaagctggcggtgaaaaaagcctgcttatgtgtgccagtattgtaatttccattgtcctgacagattattttatgctgtatatgatggaacgttttaattatcttgtgcaaaaacagtatgaggatgcaatgtacagggaagaaatgcactataaagacatctattatgaagaagcagaaaaacagaataaggaagtgcagaagttaaagcacgatatgaaacataaattgcatgaactgtatcatctggtggaaaatagtgatgggcaggaactttcagagaaaatcggtgcgatgtgcatggaatttgagcagatagatgaaaagcagtattctgataatccaatcgtagattctgtgctccgcattaaatttggcagggcaaaggcaaggggaataaaagtagaaacatctattcgtattccaaagcagatgcagcttgatcacggggatataggtgtattgtatggaaatcttgtggataatgcggtagaagcctgtagcaaggtgccggagggacagcgttttgtaaagattgaaaataagtaccagtccgggattttgcttcttataataacaaacagcaaaacaggaaagaaaaataaaagcctgaaaacaaccaagaaagataatatcagacatgggcatggtgttcagagcgttcgcaaagtggtagaaaaatacaatggaacggtcagttttacagataaaggggatatatttgaggtttctgcaatgctctatggaattgaagtgaaggaataaatgcaaagcgttacacttaaatgtcaatctgttacactttgacggattttcctgtaaagtatgatatagtgcattcatcaaatgaaaaggaggacatacatatatgtcaaaattaagaagattgatgaaccgactcagtcatggagcattaagcagcgtggcagcacttgcccttacggtaactgcaacaaatatgaaccgttgctgctggtttattttcggacaggacaagttaccggataatgcgaaaaaacttagaaaattttaaggtggtaacagggtatgattgctaaatttgcaaagaagataaatgaaatattgatacaaaaggggattgtgcaaaaagaggatgcagaactgtaccaatatgggatagaaaatggtattgttgttgcaggaaaccttttggcttctggaatatttggcattgtgacggggagaccgggacttgttctggtcttcctgttattttatgcctcgttgagaagctatagtgggggcagccactgtaagagtagaatcggctgttttttgatatcaatggcaattttatttattccggtttatacatatgagcctgtaatgaaaaatgttcctaatgccttgattttattgatcggagttcttgccgtggtaattattattgtccttgccccagtggaaagtatcaataaaccgcttgatgaggaagaaagaaggtattatgcaagggtaacacattgcataacggcattgcaggtatgtgttcttatcattttgttttgtctggatctgcaagattatttttatgctgggtatgtaagtatagtcctggtagcagtatttatggttatgggaaagattgcagtgaaacgatatgtgcaatagaaaaatcttcttaaaatgatatattaaatttgtgactgcttttacataagattgggctaagatgggtagaaatttacgttttgtcgtattttgtgttgaaaaaatcgtacttcgtgtaagatatattgaaaaaagtaggaaaaatgatatggttatggtgaagtagtaaaaaagttatcaatagtatttgtaatagtttgtataattgatttttttgacagcaaaagcaacaatgaaaaatgtgccgtcaagatgatggcacattttctatatatatgatatttatttagataatatgcggagtgctttatatttatttaatggaaaaataaaaattaccgatatagtaggaagataggaagaaggtgagtaatatgctggaaattgctgtttgtgatgacgatatagcagatcttgagtgtgcagtgaatatgctgcataagatttttacaggtcaaaagattgcttatcatatagagaaatttatgtctgcaaatcaaatgcttgaaaatatcagtcgtattgatatcggaattttagatatttcgatggaagaactgaatggtattaaactggggagaaaattgaaagaaaaatttccagatgtgaaattagtgtatattacgagttatgaagaatattgtatgcaggtcattaacgaagttcatgcattttcatttctatgtaaaccactggaatatgataaattggaattgcagatattggaacttctgaatcaactgccggatgccatagtagaaaagaatttttataaagtgactgacagcaatggaaaagagtatctgtcgatcaaactgaaactgagggatattttatattttgaatacataaaaagatccagaaaagtactgatagcattgtctgatattacatatgagtatgattgtatctttgaaaaactggttgaagaactgcaaccatatgattttgttgtgaattgtagaggaaatctggttaatttaaggcatattgaaaaaataaagggctttattatttatatggataatggaaaagaacttcagattgcacaaaggagaagcaacgattttagagaagaagtaaataaatttttgcagagaaattcataggaggaaaaatgaatacgattttactggtattatgtaatgcactttcatgttttataataagtacgatattatttcagtttatgaatggaaagtataaaaagagtagtcgaaatagatatgtatatattgtgattgagactaccacagtaatatttacattctgtataaatatgctcaatcattccatattaaatctaatagtctggggcgttttgacagggattatagcatatgttctgtattatgaggatatagataaacccttaagacgtattattgaatgtgaagcattagtattttgtatgtctgtttgtgaatcattgggagtgattcttttacaatgcattttgcaagccgcagatataaaaaatgtgaatgaaactatgctttattgccttgaggtaacattttcaaaggtgatacttatttttttgtattacacatttataaacaggtttgtgaaaaaaagtgatgtcccttattcaaagacacggtacatcatgtatggaattatacttctatacagtctgattaacatgagtgtaattgtagagaattttaaaaatggagaagaaaattatttgtgtgcagtcaacatgggatgtattgttctggcagatttataccttttatattttgtaaaaatggcagatgaaaagaactattacgaaaagcagttgatcgcattagagcagcaggcaaaggtacaatacgaatactatttgacccagacaaaaaagtatgatcaaaccattcagatattacatgatgtaaataagcatattaaagcaatcgaagggttatatggtgcagagcaggaaaaaacggcaggagaatatgcaacaaagatcagagagttgttgaagccgctcattccggttcaatacacagaaaatccgatcttgaatatacttcttactgataaagaagctgttatgagagaaaaggggatttcagtaacaataaaggtagataatgtgaatttgaatttcattgaaccaatcgacattacaactatttttggaaatttattagataatgcgattgaagcaacagaaaagctgaaaggcgagaaatatatttgcattaagattggttcatatcataagatgatagttgtcagcattgaaaataattgtaatgaagtaaagtggagaaatggttttccagtatcaaataaaggaaaaaatggtggaataggactgctgaatgttcagagcagtataaaaaaatatgatggagatttaacattgaagaatgatggaaataaatttattgctgagttattccttaattcataaaagagcatttttggctatttttttgtaaaaagtcttacttcgtgcaaaaaaatcgtacttggtgcagaaaaggtaaaatatcagaaggggtgtgtcgatagaaaaaataaagtggatgatacatataaaaaatttaatgatgggaggtttcgcttatgtcaagaattacggactacggttttttatttcaaacaacatttggaacatcaaaaacaaatttggtcaacaatattcagttgtccaaaatgaacagcagttctgtacaaaaacaattaaaagcagcagggattgacacaaacagtaaaaagtataaagcagcactgagtgagatgatgaagaatggaaacggtgcaatgtttacaaatgttcaggcaattaagaacctgatgagccagtatgacaaaaacggagactggattgatccgaataccggattaacaggacttgctgtaacggatgagaacagaaacagttataaacatatcatttctattccagagagcagccgggaagaaatgtttgaactggcaaagaaagaattcttaaatgaaaacggtactttaaatggtgatactaccaaaagggagagcgtatataacaatttatacagaaaaatggataaggatgaccgcttatcagcaggctggacaatggaacaatatgaacatcaatacagacaggcatttgcagaagcagcaaaagccgctgatcctacatggaaagctgggaaatcaataccggctggtgcattggatggtattaccagagagtctgttgagagtggcaagaaatcagtagatataaaaatatagtatgttttttatgtggaatatatttcatttttgaaggaggttgctaatatgagaatatcagaaaaagctaaaaagacggtttcaagaaaaacgtttatggcagttgttgtaagtatgatggtttgtttgctttttgtaacaccagtatttgcagcttcaagtttttatagtaagacaactactaagctgaatgctattaatggaggaaaatcaacaaccagcagtttgtcatctggtagtataattggatcagatgcttcaatcacacaggttaaattggcaatcaatgtttcgagtggaactgatccatataccctttggataaagagtccaaatggaagttggcattcttatacaggtccgacatctagtaaaatatggtatttagacgattttaatggagaaaatccgtcaggtacatggcagatatatattgtgaattcaggaacaacaactcatggaaacatatatcctgtatcaacggttacagtaggactgactgtgtattataattaagaatcaatggtgctgttaaataagaaatgaagtatatgccataaataaagtcctcttgaaaggaacagtaagttcggtacaagaggacttttttgtatgtttttataaagtattatattgtatggattcaaaaaagcggcaaataggattcatttcaatgacaagtgtttattattaagaaaaatgtcacttggagtgcataattttaagtgtaaatgacacatacatggacgcacaggaggttatgcacatgactgattatagcaaaattacagccctttactcccgcctttccgtgggcgacgaggacagggacggcggcgagagcaacagcatacagaaccaaaaaatatttttggagaactatgccagagggcagcacctaaccaatatccggcactacatcgacgatgacgaaagcggcaggttttttgaccgttccgcctactcccgcatgatggacgatgtggaaaacgggaaaatcggtgtctgcattatgaaagaccttacccgctgggggcgcgactatctccaagtcggcaacgcgatggagatattcagacggaacaatgtgcgctttatcgcagtcaacaacggcattgacagcgagaaacccgacacattggagtttgcgccctttatcaacatcatgtcggagtggtacgcaaaggacatcagcaagaaagtgaaaacgggcattaagaccaaaggcatgagcggaaagccgattgtcaccgaagccctttacggttatgtcaaagacccggacaacaaggatttttggataatcgacgaggaagccgccgaggttgtccgtttgattttccgtctgtttatcggcgggaagaaccgcaaccaaatcgccgtatatctgacacaggagcaaatcccaacccccactttctacatgaaagaccgagggcggggaacctgtaaaaataagacactcaacgaggataaccgctgcaagtggaacaaagccaccttgaccaatatcctcacacggcaggagtattgcggcgatgtagtcaacttcaagactacaaagcatttccgggataaacataaccactatgtagaccggagccagtggcacatcacagaaaatgtgcatgagccgattatcagccgcagcgattttgaaaccgtacagcggattttggaaaacgcacccatcagacgccccaacggggacggggaaatccaccctctgtccggcttgcttttctgtaaagactgcggcgcaaaaatgcacattcgtatagattaccggaacggcggcaagcggcacgttgctttttgcagcgagtaccacaaggggaaagccaagaaccccaaatgccattcccctcacatcatggacgcggatttgctcatgcagaccatcgcggaagtgctgaagaaaatcgaggactgttctatcagcaaccgggcggagtttgaagccttagtgaaaaagaaccttgccatgcagcagaccgaccagaccaagaagcagcagaagcgtatcccgcaaatcacgacgcgccttgaacagattgacaaggtgctgaacaagctctatgaggacaacgccctcggcgcgatcccgcaagaccgctatgagcagatgtcgcagaagtattcggaagaatactacgcgctgaaagcggagcttgccacgctccaagagcagctatccgcttatgagaacgcgggaggacgggcgcagaagtttttgaagctgacggaacgccatgctgcctttaccgagcttacccccgccattctcaacgagtttatcagccggattgaagtgcatgagcgcgaccagaaaagggcgagatacgcaatccagcacatcagcatatatttcaattatatcggcaagtttgagaacgaagtgacacagcttgcagagccgaccgagcaggaaatccggcaaatgcgggaggaaatcgaagaagccaaaaaggaaaagagccgcgcctaccaccgcaactattcaagggaataccgggcgagaaatcttgaaaagcagcgggagtatgaccgcatgaaagcgcgggaataccgggcaaggcgaaaggcacaggcagccgcacagcccgcacagtaaaacagaataaccgtcaaccaagagggattttccgaactacgggaaatccctcttttgcgctcaaagaaaggagccgcctatggcagaacagacccccgacagtatcattacgacccagaggaacgggcagaccattgttgtggagttatttttcaatcacagcagcacagaaacattccgcgacaagctgctcaaactggcacttgccgacagctcgcgtttatccgcgtctgacggtcaagagccggaaaaacagaaatcttgcgataacagccgccccgacgaaccattccctgtccgggcgttttctatttgaaaatcctcattttccacaagtcaagagccgggaaaaacacccgaaaaatgcccctattgcgtaacaggggcatggaaaggagcttacatgagaacagggcttaccaaacaggaaaagaccaccgatatatggtttgacgagaaagacccccttatccatatccgcacacacaacaccgacttaaagaagcggcttgccgcctactccggacagcaccccgaccagtgccgccagaccgacgcagaccccgaaacgggctgcatggagtttgagattgcaaaggggcgtttctctttccgtctgaccgccccatacagtgaggaacggaggaacgccgccagcaaagcggcaaagaaacattccggcaacttgacacaccctattcaaaaagatgtgctataatttttttgaaaaagtttcggattagatgtagtatttgccgctgaaaccgtagtacataggtgaagcccgaaaggaggcggtgagatgatagacgacgaaaaaatcatagaaatgttttttggacgttcagaacaaggcatacgagagctggatataaaatacggaaaggtctgccacaatctttcctaccatatcgtaggcagcagacaagacgcggaggaatgtgtaaacgacgcttatttaggcgcatggaacgccattcccccggcacgacctaacccgctgctatcttatcttgttaaaatcgttcggaacatttcactcaaaatctattggagaaaggaagcagccaaacggagcagccattacacgattgctttggaagaaattgaagcctgtatagcagccccgaatacagtagaagcagaaatcgaagccaaagagttagcccgtatcattgaagcatttttagacacgctgactaccgaaaaccgcgttattttcatgcgccgctattggttttccgacagctataaggacatagccgagtttatggggctttcagaaaaaaacatttctgtccggctgacccgtatccgcgagaagatgaagcaatatttgattgaaagagaggtattcgtatgaatgcaaagaagttttccgacgctatgagcgagcttgacacaaaatatgtcgatgaagctctcaactacaagaagaaagccaaaaagcccatttgggtaaagtggggggctattgcagcttgcttgtgcttgatgataccattgaccgcatttgccgttgatataattcaatataatgcagcggttgattatctcaattctctcggcattgctgttgaagatttgagcgactattctcataaagaaataaaagaagctgcaaaaacgattgacgcaggagaaagtaacccgttgactgaagaaatccttagtctaataccagaaaacaaagaaccgctcgatacaccgacgcaggtaacatctgagcaaattaaagaactaacaccgaccatgacaagagaagatgttctttctcttttaggtgacacacaagatgttggctcaggcatttatatatatctttacgaagtagaccaacaatacctgttgcgtattccttttgcaagcgatgaagcacaattaggtgtaacaggagaagatttgctaaaggcattggttcccatttctggagatattgctcctatggtctatgtaaatgatacgctttatcaaatcgttgactctcaacccaacttcgcagatgaaaaaagttctttcaatttgttgggaaaaatcgaaaacacagttagttcttcggaagaaccaaaagaaaatttccaagcaaatgatgatattgtaggggctgcggtttatcagtacggcgataacattgtcgttgagtttgagggaaaatactggttatatgaacactatcataacacagactttgacggaaactcagactgatatgccccacgcccaaacaagccatacttctgatgaaaaagtatccgaacaaaaccttcttgcaaagtaaataagttttctattttacaagggcagccgagaaaatcgactgtcctttttctatgcttatgagcagaaaggagcgcccaaccatgacaaagccaagagagaaaacccgcgaggagttgcaagccgagattgaggacggaaagaagaaaatccggcaatttgagaaccgggaaaagatgttgcgtcagaagctatccaaagaggaacgcagaacgcgcagccaccgccttatcgtccggggcgcagtctttgaaagcattgtgccggaagcaaagaacatgaccgacgaggaagccgcagcacttcttaggcttgccttgacgagtgaaccagcgcgggaatatctgaaaaaacgagcagagggagcgacaagctgaaaatcccttaggaactaagggcgcacttatacacccttacgggcgtgtgcgctctgccgagggcttatctccgcacagggagatttccccgcgctccgatatggcggctttgccgcaacaaggggctgcaccccttgcgccgcttcgcggctatccctgcacacccacaaaaacagtacacccgcctttggcgtctgtaccatttttgagggttttattatcctatccgggaggtgatacccatagccatttaccattggaacatcggcattgtgagccgaggaaaaggcaaatcagccgttgccgcagccgcctaccgaagcggcgaaaagctgacaaacgaatgggacggaatgacccatgactacactcgcaaaggcggcgttgtccatacagaaatcatattgccgccccacgcaccgccctcattcgctgaccgttcaaccttgtggaacagcgtggagctttacgagaaagccgggaacgcccagcttgcgcgtgggattgacgcagcactccccatagaattatccagagaggaacagatccggcttgtccgggaatactgttcctctcaatttgtttccagaggaatgtgtgtggattttgttatccacgacaccaacagcggcaacccccattgtcatattatgcttaccatgcgcccccttgacgagcgcggcgcgtgggcagcaaagtccaaaaaggaatatgaccttgatgaaaacggtgagcgtatccgcttgccaagcggcagatataagacgcacaaggttgacctcacgggctggaacagccaagagaatgcgcttgtttggcgcaaggcatgggctgatatttcaaacgactatcttgagcgtgccggaagcccggagcgtatcgaccaccgcagtaacgccgagcgcggcattgacgaaataccgaccatccatatgggcgtagccgcctgtcaaatggagaagaaaggtgtagccaccgagaaaggcgaactgaaccgaaatatccaaaaagcaaaccgccttatccgggaaatccgggcgcaggttagcaagctcaaagaatggattgccgacctgttcaaagtgtgggaaaccgccccgaagcagccggcgcaatctcccaaccttgcaaatctgctgatgaaatatttgagcgttcagagagaaaagagccggaagtattcgcagcgttggcaacaacagcacgcagccgatgaactgaaaaccatagcggcagcggtcaactatctctccgagcatggcatctctaatcttgacgagctggacgtttctctttcctctgtcagtgatagagcctattcaatccgggcaggaatgaaaaccgccgaggaacgcatgaagaagctacaaaagctaattgaatacgggaagaattacacagagtacaagcccattcacgatgaactgaaaaagctgcaaaacggctggacaaacaagcgcgacaagtacgaggaagcccaccgcgccgagctgaccctatgggacgcggcaaaccgctatctccatgcaaatctgccgaaaggaacaaagaccttgcctattgcggaatgggaacaggaatatgctgacctcaaaacacagagggacagcgattataccaaactgaaagatacccgcaccaatgtttcaaagcttcaaaaaatccgcaaatgcgtggatattgcactccgcgccgaccagccggagcagacgcagagccgcaccaaacggcatgatatagaccgctgaaaggagttgaacttttatgtattacacccaagaacagatagaccgcgccaaccaagccgaccttgtttctttcctgcaaggacggggcgagcagcttacccgcgccggaaatgaataccgctggaagcggcacgacagcttgaccgtccggggaaacaaatggtataggcacagccagagcaaaggcggcgcacccgttgattttgtcatggagtttttcggcaagagcgtcaccgaagccgttgaactgctgacaggcgaaaaaggagccgccccgccgccggacagaccaagccccgcgcccctatccgacttccgactgccaccccgcagcaccgacaaccgcatagcgaggaactacctcacagcagcccgccgcattgatgaagatgtgacgggctttttcttttccaccggggatatttacgaggaagccgcccaccataacgccgtattcgtcggcagagatgaaagcggcataccgcgatacgcccatcagcgcggcacagccgggagttttcggcttgatgtgaaaggcagcgacaaagcctttaacttctgctaccgtggcgagggcgaaaggttgtttgtctttgaagccccgatagacctcttatctttcctctgcctgttcaaaaaggactggcagaagcaaagctatctggcgttgggcggcgtgggagaaaaagccctgttgcgctttctctctgaccgtctgaacatcaagaccgtttacctctgccttgacaacgacaacgccggaaacgatgcttgcagccgccttgcggagcttgtgccggagggcttgaccgtccaccgccttgtgccgctttacaaggactggaacgaggtattgcagcaccgggcagaaatcgcggacggtaagtatatccgggaagcgatttacggcttgaaagagccaccgcaggaagaaaccgttgagattatccgcatgagcgaggttgatacacagaccgttaaatggctatgggagccgtatatcccctttgggaaagtaaccattgtgcagggcaatcccggcgagggcaagaccacttttgccctacgccttgccgccgcctgcaccaccgggggaacgctgccgggaatgaagcccttgccgccattccaagtaatttaccagaccgccgaggacgggctgggcgataccgtcaagccacgcttgatagaagccgccgcagaccttgaccgggtgcttgtgattgatgaagccaaacgggagcttaccctgtccgatgagcgcatagaaaaggcaatcacgcagaacggggcgcggctgattatccttgaccccatacaggcgtacatgggtgaaaaaaccgacatgaaccgggcaaacgaagtgcgccccatgttccgccgccttgccgatgttgccgagcgtaccgggtgcgccgttatccttatcggacatctcaacaaagctgccggagggcagagcgcataccggggcttaggttctatcgacttccgcgccgcagcaaggagcgtcctgctgatcgggcgcgtgaagcgagaaccgaatgtgcgcgttatcgtccatgacaaatcttcccttgcaccggagggcaagcccgttgccttttgccttgacccggaaacgggcttttcatggataggcgaatacgacatcaccgccgacgagctgctgtccggcgcgggcggcaacaacgccaccaaaaccgaacaggctgaaaggctgatacttgacctgcttgcagacgggaaagagcttgccagcgaggacgttgtaaaagccgcagccgaagccggaatatccgaaaggacggtacagaacgccaagcgcaacatgggcggcattttaggcgcaaggcgtgtcggcggtcaatggtacaacttcatcaagaagaagcagccacccgaacccgcaagctgaaagtgcaaaacgcagaccctttgcactttgcgctttcgcactttcacgataatttgcgtcaataactcaaaaaagcacttgacaaaacgcttcatgatagataattatggaaataattacattggtttgttatactaaataaaaagcaaagggggaaagttatgtttaagaagatgccggtatgcagactgatgatttcgtgtccttctgatgtaaaaacagaggtagagattataaatagagttgtggataatataaatgattctataggtatttctatggatatttttgtaaaaacgctgtattggtcaaagaatgttatgccagaagcgggaaattatccacaaagcattatcaataaacagattttagataaatcggatgcaattattgctatatttggtaatagaataggaagtcctacacaacattatgaatcaggaacaatagaagaaattgaattgatgatacagaagggaaaacaggtatttgtatatttttctgataagccagtacgaaaaagtgaaattgatatggaagcggagacaaagatacaggcatttaaggagaaatacaaggacagaggaatatatgttgtttatgcttctgatgaggaatttaatgattatgtcagtatgcaccttacacgctatcttacaacggaacttgcaaatgaagtaaatcgtgtgaatgagcatacaagatttgacgattctatatcacagagaaaagaagttgatttaatttacgattatactaagttttatgatataaaacaggttagttcttatactgattcaaatattatgaaaataagaacacataaagacagttttgaaatggatattgacataatcaatgtaaataaaatagaaaatcaggaatttgcaatggcattatttgaatatgctccatgtgataactggtcagctttttttgaagcaggatatttttttgaatttgatgcggcaagtagtggagatataagagcttttcaattggaaataaaagatgatatacgaaataaggtaattgatagaacattacaggttagctgcgaggaagaacatttccgaatatggattccttctacaacaagagattcaactgcgtggaaaaaaatatcgcaggtttgttttgttgtatttttcaatagtacatatattgatggagaaaaaggtctgttgacaatcagaaatcttaaaatggtgccccgataggataatactttgaaagtatgcagaaaagtctaaaagatattgaggaaaatcatgtaagaggtaatgatagacttatttaggtaggtaagcaattttcggatttaaagcagtaacagaaaattaaaattgtagataagtaaataaaataatagaaaaaattatatgcatctaatccatttgcggtttaggtgctatttttttgacaatatgaatgcgatcgctcgtaatatcaatatgtttatcaataaaaatatatgaagcaacagaacagatgatattatattcatcagcatttttgcttttttttgctttttaataagtgaaaagtcttacttcgtgcaaaaaaatcgtacttggtgcaaaaaaggtaaaattttataagatgcttgtcgatagaaaaagaaaaaataaggaggttttcaagcatgaaaaaacttaatgatgtagcattgaaattacttgcaaaagcagcatatgcaaacgcagagaaagaggcaaattcagcgtgcctgtttattggctatcagcctaaaatgccacagaaagtaaaagaactgaaagaaagaaaatagtattttcctatggacaaattgctgaaaaatgttctatcttgcatgaggacaaaaggacttctggataaaaatgaggaagatgtatatcgctttggcttagaatgcttattgttagaggtggtacattacttgtcatacatagtaattggttttgctatgcgaatgataatacccatgattgtaactgcaatggtgttaataccattgcgtagaaaatcgggtggctttcatgcgagaacaaggagtggatgctatttattttcatgttccatagttgttgcggtatgtttattggataaaatcatttttccactatggttatgtactgcaactacatttggggcaaatgcaattatatttgcatttgctccaatagaaaatgaaaatcgaacattagatcaagaggaacagaaaaaatttagaaaacaggcgttaataattttagtattggcagatatggcaattattatatcacacaaaattcatattgaagtatgccagtggttattaaacggtatgatagttgctgcactactgaatttgtgtggaaaaattcagacaaaatgcaaattagaaaaaatatggtaggaactattgctaaagagtggaaaaaggtaacaaaaaattgtttccaataaaaaattatcgttgtgttggaacaaacatacttgtatagacgagaagttttgaaatcgctttacaggaggggcataatacttggttgtgttatgttagagacagatagggtttacattagttacatggcaatagctgttatattatatgcagctttgcttagtatagcaaaaattttaaataggaggtgagaaagaataaagcagattaataagaatgtgctgaaagttgtagagcgtgtcatgagaaatgaagctgtatatgggataaatggattttccacaccatgtatggaaatacttcatcagccgaaacgcccgattagccagaaaaaaagtgaaagatagttagctggcgttttttactattatatctgtagccatagatgctataggaatttaattatttattctaagatgacaagtacaaaaaggaggaaagatagtaagcgatgaataacacaccgcctacccaaaacagtaaacgactaccatttactttaggttttccctgctatctacatggcaggggaattctgttttccgggacattggattccacatcaatgatccccgaacactgctctttgataaattcactccatggcatcagctgttctatacctgcggacgagttcatataatccggcatatacagcagtaccatatagagatattggaaaatattcagattgtttgcttttgctgtttccacaatgctgtacattaccgcacttgccccagctccagcttctgatgtatggaacaggaaggctttccgcccaacggcataacttttggctttccgttccgcacggttgtttgaaatttcacaccggccatctatcatatagttcatcaaggtatcatgatgattttgggcatagttcaccgctttcccaagcttgcttccgccagttggatgcagtgtgccaagccagttccagaactgttcccatacaggctgttccagaatggttctttgttgttttcgttcttctgcctccagttcttttaatgtgcgctccaggtagaagagcttattgcaatacagcagtccaatttctgccgggagcagctgttccagcttctcttcatccggaataccggtatcctcgatcgcttcatcagagttaacatccagaagtttcaactttttacgtctggctgccgggactgcttcaaagaacttacgtcttgcatgtgcaaggcagcagaccagtatgacatcttcaagcctgttgtaaccctgatatccgtcacactgtaccattccatggaatccttccagaaattcctgcacacaggatcctttccggcttggctggtaatcataaaggacaattggtgtaagaccatcatttccggttgtatataaccacatataagaggtctgttccgccgtacgtcccttttcccgcagcacctgacatgttgtctcatctgcatgtaccaggtcccgctttaaaagttcttcatgcagccgatcatagatcagatagaaatagttttctgccgtataaatgatccagttcgccatggtttcccgtggcagggtaaatcccagctggttcatcagaaattcctgacgatagtaaggcattgccatgccgatcttttccattgcaacatatgcgaccatggatggggaagccgggctgtgtggaatcaatgctgtaggtatcttggattcagcaaatgtcccgtcaccatcttttctgcattccgggcactgccatttctcctgataatagtggattcgttccacctttgccggggtgatccgtagttcttcacggacaaacatttccgtcacatactccatcttggaattacaataaggacaatacttatcttcttccagcagggggatgacttccttatggatcggaagatttccatattggtcttcacgtgtcgctttcgctttgcgtgttgtccgtttgtggcttttgacgattgttgtcacagtttcttccgttttcttatcctgttttgtcttctcactgcctgtaccaaagagtttccgctggaattcatccagtgtttccctgagaccggcaattgtatctttcaggtcattgatggtttccttcagttctgtgatggtttcgtctttttcatctaaccgttcagaaagcatctggatcataaggtccttctgattcatctcactgttaaaaagtatgtcctgtccctttgaatccacggtgaatccctccctcttttttcgttacctttattgtacgaaaaggaaggcatggttgcaaatgccgtccaaaatcagactggcattatgccgaaagccagatagctcctttttttctcaaaatcagccagtttccgggattttccgtaaagttatgcacatcatgatgatgtcatgctcaactatccccggacaacgcaccccatgatttcacatctgtggatatcttccgtcaacagcctgctccggctgtagaaaaatttttcaaaatctacatattgcacaaatcagtaatccctgtctttcgcaggctgtatcgctttcggctggtcaatggaaagtccttccatcagccagcggaattcctgccttgtcagaggtctgacttctgaagcattgcgtggccattggaattttccattgtccaggcgcttctgcaggagtacaaatccatcccggtcaaaatagagggctttcatcgtattctttttgcgtccacagaacagaaagaccgcattggagaacggatccatctggaaattgtcacggatgactgccatgagtccgtcaaaggattttctcatatcagtccttcctgtaaccagatagattttctgtactctggacagatcaccgatcaaagtttccgcagggcagatatcgtatgatagatcacatccctgcctgcatgattattgattgcaactttacagccgtttatgataactgtcagtgcttcgccctctgatgttgcatctgttgacagcagtctgactggattcgatatcggtatatgcgattcttctgtaatggaaagtggtacgatttcatgtgtggcatccacgattagcctgtctgtctccggaatcatacatgatttctttctcagccttgtgacagtattataaaacgtattgatagagatatcattctgctcacaccagacacggtcagaaaatccactgctgcgacattgctgaattaatgacagccattcttcgtctgttcttctcttattacgcataagctgctcctcctgttagctaaagtagttaaacaccgtaaacggctacctttgcttaagaaaagaagagtgatacgtccgcatccagatctgaaaatagataaagtagtcgtttactgtttattgactgtattatcccaaatcttcaattaaatttggaacggtatgttattcatcgcttacgaaagataatgaaattaagaaacaaagcagcgatgttgttagcattttccatgatggtatctttaggaagtgtagcaactgttaatgcagcagaaatggaaaatgaattttcaacattgaaggagagtagcagttttgaagaagtagcggaggttggctctttggaacagttcaagggagattcaattgataagattaagatggacgatagtggcatagcattaactgctactggtgattcttatgaggcgaacaatggtccggctgttgctacaaagggaagatataacaagatcacatatgcttcacttcatgatgcaaatgatgtagattggtatacaattgaagtattggacacttccaaaccgattagtgtctttttgacgaatataccaagcggctgtgattatgatatgtatttattgaagtatgattctacacttggaattactaaaatgtattataatcttcagagtggaactacggcagaagaattgtatggaactgtggatgaagtcggtacatattatgtagttgtacaagccagcacatcctcatctatagagaacaattttagctcatctaattatacactctatatgggcgattattacagagtaggtcagtatggttatgtagatacaggtttggatattagctttggaaatataccagtgggaaatacaactcctgtatataggggatggtatacttatgatttgagtaatgaggcaagtattccaaatgatgctattgtaacaaaaatatatttgactggtaatggaaatggtgcatattggcttggcttctataaaatgatggcagcggctggtcagggaattcaattagaatcaaaaattggtcaaattgaagtaatgtattctggggataatcagcttttggctaaacagaaatggttaatcggtggcaaaattatggcaagtacaaactttgtgtgggaaccacagattttaattgcatataagtatgcagcaacaatttcaaatatgagattttttgcttgatttacaaagagtgatttatggaaacataaacgataattacatgcaattttacttgcgagaatatttttacgcttcttagcctgtgcagactaagaggcgtagaagtatgtaggaggttgagatgatgcaatcaatatcaagttatattaatcctaatacaagagggcttacatctaattataaaaatacagctattaaagataaggaagcatataacggggtgatgtcgcagcacttactaaatccggtagaggatctggtacaagcgttaaaaacaccaataaaattggcgaaaagtgcttcacttagcagacagaataattctgttaatattgcagaaggacaaagtattcgtgttaatggaggtcatgtgcttacggttacgacgcatggagtagaggtttctggtggagataatccgtatgatacagaatcttatgtaaaagcacaaagaatggcagatgcattggcatcaatgctacgaaatgcaggtgggacaatgactactgtagcacattccaaggaggaatatgcccggtatatagaaggaattacggatgtgatgtcttatctgggtatcgacacttccaaagattttacggtcaatggtatgcgatatagcaaaaataaagatggctggtatgagtcagaagcgaacagtgatgcacaggcggcatatgaacagttaaaagcgaataacagaacctatcagtttgcagacgaaaagaccaaaaagcagattgcatatattagagattattaccttcagacggtgccggagagtgtaaaggcggcatggcaggaaacattggaagaaaccagttttaatccatttcagacggatgcagtcagtaccttaacgcagttatctgtagagcaggattttctgacaggtggtgatgacaatatttttggagaaacgaaagaaagttgtctggcagctattgataaaatattggagagaatagaaaacccgttggcggcagttacagaggaaagggcagcatatctgcaacaggaaaaagaattttatacagtgttggcatctaaaataggagaataattttatacatgatgcaaaaatgatattgaaataggaggaatggtagtatgtttaagaaaattaaaaaagtagtggcttttgcattagctttaactatgctaatgggaatgagtacagtcgcatttgcggcagagagagaaagtgaagttccagagttgacaaaagttgacggaatgacggtggctattgatgaggataatgacaatggcatcagtcctttgtggtggtctggtaatggtccggctccacaagtaactaaaattgaactttataatcatggtttgttagataatggaaactattgtgtcatcatcaaggtttatggatatggaagtgatactacaacttttaacggaagaagtatttcgtggtttaaacagcagccgtttataatttcaggtaatggtgcggatggcttttattactggtatgattgcggaaaaataacagcacctggtaattatacatttactacaaaatttagatctaccaatttcccatatggtgagaaatccttttcatgtgtattcaaaaaaagttaaggcaggaagtgggctagaatatagagagatttttaagctgattggaggaacagaagtatgaacattggttctggtctaaatacggtatcttcaatgtaccgccaacaaaaaggcaataatatgaaagcccctgtatctgcggaaaagacattttatacggctgaaacaccaaaggtataccagatattcacaacagataatatgttgtggacaggaggtaatggtacaggtctttcttattgccttaaatatgcggatgattcgacggatgaaaatccagtggtgttagcgaaaggtgtggatgaaaacggaaaagagtttgaacaaagaatttatatcaatgacgttgatccatcaaacgccacagtagtcgaaatgcgtgcattggaggcacattacaaagtggagaagcagggaggttttacgtctttgccgcttgaagctggtaatatggggcttaatgacagaagagattttatttcaatgtttaaagaatgcatagaagatttaaacaaattgggaaggtttgatttatcgttgctttggacgaaaagtatggatgcttatcttgatttgacaagtgcaaatagtaagtataaatagtgcttagtcatttgaacatatgagaaaaagaaaacttggacttcataggagagagtagcttggttatgactgagagaagaatcatatgatttctatgattatttagcgggtaataatattggagttattatatgttaatttgaaaggagattttaaaatgaagaaggtaaaaagtttaaaggcgttggtgttgagtttgatgttatgtttggcaatgggaacaactgcgtttgcaggtgaagtatccactcagggacaggctgcgcctaatgcaaataaggcagtagaagtaagcgattgtggcaatttggacgtagtacctgcttatgatgacgccgttgctcttgcagatacgattcggtatgatgcaaatagaaccattacaagaagcaattccagaagcggtgtattcaacggaaattattattacaccattaataactcaagcgttacaaagttgtgcttagatgtttatatgcctaataaaagtggaacagattatcttcagggaacaattactcttgtaggaagtgacggaacaagtgcaccggtacaaattgctaattattcgggagattcatggacactgacatttacaggtgttaaggtaggtgttagataccatttccattatgagttgtattctgttggctcttcgcaggtaggctatattgcttctgctgcttatgcacaataatagatgctcgaatatggaatattaagcaagcacaacagaatattttcattgtatgttgcattttatagaaatctggcataaagtgcaacatactataataaaaaaattagattatattgctgctggagggattataaatatggtaaatatggtaaataccgctgtaaataacaatatttatgcaggaagaaaacctgggtcaaaatataaccagtcacatacttttcaacaaaaggaagtattagaggtaccggatggtgcagcagttaacaaatatgcaaatgttcaagaaatctatgaggcattaaaatataacgcgtcatatagagtagataaacaggagcaggatgaaattgctgagaaagaaattcaaaatgaagaaccagaaataagcaatgattccagtgaaaaaatgacagcatggtatcagggtgttcctttgaaagaatgggcattaacggatcctaaatacacggattcagaaacgggaatttcatggtatattagagacggaaaatatccgtatatggtaggtgaggatgcagaaaagttccgaaaactttgtgaagaatccggggagttccctctaaagaaatttggggaaatgacgggattaatacagaaattagatgacaatacagtagcgtatgtgggtgataacggaattgcagttaaatctaaagatgggaaagagatgtttgtggacacatctggcttgtcatatgatattgttatggatatgttcagaaatttgcctagaaatgggaattttttcagcaataagtattggtcagataatatacagaaagcacaggctcggagctgatgatacgttatattgcaagagtgtgtatgcttggactccgataggagaaagcagattggttctgattgacagaagaatcatatgatttcatcattaatttggtaggcaataatattcaaattattgcctgctaaatttttaccaaaattcttctaataccgtttttggactagaaatgaaaagaaaatgaatatatcgaaagaagaatctgaaaagttagaaaataattggaagattggtttgattgtagtataatattaaaagaggtgcgagctgagaaatcagcatagctgatttcccctagcaagcggaagtaattctgcaagctttggtaagctgataataatacagtaggaaaaatcctatcaggtaaggtctaaccaaccgcctgtaccgagtccttggagccgaagcggtaacgttaggtttaagcgtaggacagggagcaacagagccgaaacgaaagtgaagtgattgagctgggaaattattatgaggttggaaatggtcgatgtgttcttattcacagcagacaatatcgttgtaaccgttagggcgaggttatgatggcatcccccagtcagagaacttggcgaggttgatgataagtatgttatcggaacagctgagatcctattatctcctcaaatgaggtatgatgtacaatcaaaggaataagagaggaagtcaaacggataataggaagtccgagtgctcatagtaccgaagaaactgctaatcacagtggagggaaggggcacaccttatatggatgtaaagaactattgcgtggacaagagagccaattagtgcaatgctcgaagttgaagtatagggttaagccgtatgccttaatagggcacgtgcggtttgaatgagggatatggggagcaatccccatatctacttaagtaaaagcacacaagaaggcccgtaaatcgaaagctgcttatgatgaggtctttgctgatcttccgacagagaatgtttatgtagatactcttacggaagaacagaaaacgtgtgatgtttgtggaacaatgatgattcctatcggacacgaacccatccggacagaactgcgttatacagagccaaagctggagcgtattgattattatgcgactacctatgagtgtccacaatgcaaggaaacggaagatccccggttcatcaaggacgaaggaactcctgcactgatcccggggagttatgcatcgtccggtcttgcagcacatgtgatgtattataaatatgtcatgtctatgcccttataccgtcaggagaaggactttgaacaccttgggataaagatcagccgtacgaccatggccggttggatcatctactgcgcagagaattactttttgccaatgtatgaatatctgcaccggaaactgttgaaacgcagatatctgatggcagatgagactccgatccaggtattaaaggaagaaggccgcagaccacagagtaaatcttatgtctggctggtacgaactggtgacaatggtgggattcctatcatcctttataattacactccgaccagagccggcagtcatgccgctgcttttcttgcaggtgcagatcccggatactatctaatggttgatggttataaaggatacaacaaagtgccggaggcacagcgttgttgttgctgggctcacatacgacgctattggctgcgggcaatacccaatgaacttgatccacttaaatatctgagcttccttctagagcatcgtcctggtgctgaaatgtcagacgaggaattggaacaatttgccccgtggagtaaattggctcagggaacttgtaaataaaatgtagtgaaatactcgtatgtctggcattctagcgcggggtgtcagatttaatttatagggtacgccctaaaactatgcgcttaccatttatagttataaaatatataataatataaacttaaactttttctaatacaattatggagggaattatggaaattattagtgtagaacatttgaaaaaatattatggtaaagtgccaaatcaaacaaaagcggtaaatgatataagtttttctgtacagaaaggagaatttgtttccataattggtagttctggcagtggaaaatctacgttacttaatatgattggcggattagacactccaacttcagggaatgtatatattttggggaaagatattacttctatgtctgaggaagaattgacactatttcgtagaaaaaatataggatttatttttcaaaattataatttgattcctgttttaagtgtctatgaaaatatagttttgccagtagaacttgacgggagaaaaatagataaagattttttagatgatgttttagatatactttcattaaaggagaaaatctttaatcttccgaatacgctctctggaggacaacaacagagagtggctattgctcgtgctattatatcgaaaccggctgttatattagcagatgaaccaactggaaatttggatagtaaaacgagtggagatgtgataaagcttttaagaacagtcaaccagcgtttcgaacaaacgctgattatgattacacataatttggaaatagctcagttgtcggatcgcataataaatattatagatggaaaggtagatatatgaaaaaaaatttttattataaaatgaatttaaggcgtatatggggattgtctaagaaaatttttttgtcaaatctatatcgaaatgttgtggtaattattgcggtagttttgtccacttttatgttgacatctgtgtttagtgttggatttagttatatagagacggcacaattacaacaaattcgtgcgatggggacaacggctcatgtggctattaataaccctagtgatttgcaagtatctgagataaagaaatcagattcgattaaagatattgggatttctcaacatttaggacaaattgacggtttggaagatgaagatttgttgctagggctaaattggatagatgaaaatgaatggaaccttcatagggtgcccactatttcagatgttgttggaaactaccctgttacagaaaatgaagtaatgatacctacatggattttagagcgtttgggaataacaaatccacaagaaggtatgtctatttctttgtcgtatcatttggatgacgatgattctattaagacgcaagagtttattttggcgggatactatacagactactctcaagttaggactaatgacaaaggaagcatttacgtttcagaagaatttaaaaataaggctgctatctctactggtaaagtagttatggtgtcttttgaagatacaggagatattcaaaaagagtgtgataggttaaaggacaaggtgaaattttcttcaacacagagttttgaaattgttcctgtaacacaagtgaacagccaagtattaattataggcattgtctttatactattattcatatttattagcggctatttgttaatacataatgttttatatattagtatagttagagatatccgcttttttggtcaacttcgattaataggatttaccaaaaaagaagtacgaaaaattgtttatcagcaagttttgtatattactgttattggaattccgataggcttgatattgggagctgcagtatcttttggtatcgtgccatatagtttaaatgtgctatattcggggaatgaagatttaggattgcaaatttcgttctctccgttcgtttttataggagccacaatattttcttttgtcactgcaagaatagggtgtgttaaacctgcgaaaatagccgcccaggtttctcctattgcggcaatgtcatataatgatgtggattcgaaaaaattgtataagcgtaggaataaggtatttagattaacaagaatggcgtttcaaaatatttttcgctctaaaaaaagcgcaatattggttatttcttctttgtttttagggctggcgttatattggatagcaacgtctttattgtcgagtattagtccggaaaactttatacagcaatggggtgaaagcgactttgcaattacttatagtattcatgatgatggaagtccaatcacggcagatatgctagaagatattaaaaatatctctggaattcaaaacttaagagttacctatgttgccaaagaacgtgttacttttgatgtgcagtatgatgaggaggtatttggcgcatatgtggattcattagaaggaaaagcaggtatagacttttcttcttctgaaaaacgcgaatcatatacggagaatttttatagtggtgtttatggaattgataatagttatatagaagaattaaataaaacacttgaacatcctattgatctagaggcgtttcaagatggtaagattgttgtgcttcagacaattacaaatgaggatggggaaaatttaattcaacctaatcagattattactataaaaactaaaggggccgagacggagtttgaagttgctgatggtttttttagcgctgattttcaaggagggaggggaaatgaaaaaggaacagccccggatttatatataagcaaaacggcgcttgaaggtttaacttctcaaattaaaatttttcgaattgcatttgacactgatggaaaacatgatgatgaagttttaatgcaacttcaaacgattgcttctttgaattcggatattcaaataatatctaggattgaaaaagctaaagagatggaaggttacattttgacaactaaagttttaacgataggattgtcttttatatttttgctagtaggaatacttaattttgttacaacaatgattacgagtgtaaataaccgaaaacaagaatttgcaattttggaaagtattggtatgacgcatagacagcaattaaagattttattgattgagggattttattattggataatttcatttatattattgctcatagtaggaaatggaatatatattcccttgtatttttggtttaagcaaattgtttcgtatgcttcttttaaaatgccgtatgcttctttgttaattgttttaataattatttttatggtatgtttagtaacgccgttttttgcatatcaaagcattttaaaagataggctgattgagcgaattaataagcaataatttcttcgcagatagaatttgagtgtagattagatagaagatttattactttttaaaaataaaagtccaatcaggagtttgcgattcaagagaatccataaccatgattagggcttttgcttattggtaaacgtggctatttagtaaggacaaactcgctgtatattgtatattgttttttaaaatgttaaaattaatcatattggtatgagtaaaaaatggttattatataatctttgagggggttgcagatggaattaaaaacttttttgaaacgtttactaaaaatagtagatatagagaaaaaaaagtatatcgttaatcagataaaatgtttttctttcttaatgatctatacaattgcttctgtaatatttcctagttttttaagcaaaattgttgatctgggagttgttatgggagatgtttcaaatatagtgttgtatactactgagatgttgatttgcgggatattaatggtaattttctattatttgcaaaaagtatttttttttaaattcggtaatgatatagtattaaggacaaaacaaaaattatataaaaagcttaatacagttgatattcaattttggaaccagtacaaagtaggggatgtactcacaattttagataatgacatagaaaaattgcaagaactactaacatctgatatcagcgaattggtagtaaatatttgtttgtgtatagggattagttcatatataattatattaaatcctaaaattggcattttggttgttgtaatgtcaattatatttgcatttattcagcgaaaagtggcaaataagagtaaagaacgtatgaaaaagttgagagtgactatgggagattttaactcattttccactgaaaccattaataatatgccttcattacaaatgacgggaaaaactcaatatataaaaaaaatgtatgcagataaatgtgatgaactggctaaagaaggattagattttacgaaaaccatgtgtactgttggaatgacaggaatgtcttttaatgttcttgcaattgttattgtattaattttaggtgctgttgatgtttctaataatttgatttctgttggtttgttgtttagtatgactatttatgtgcaaagattatatagtcctatagtatcaataggaaatatgtttgttaaaataaaaaatttctttcctttattagataacatttataatgtaatgtttaatgaaaaaaatataatcaagggagattataaacacagcagcgagcttatgggaaatatttcttttgataatgtatggtttggttataacaatgaaagatttatattgaaaggatttaccgaaacgtttaatagaggagaaatcattggtattgtagggaacaatggaagcggaaaaactacattagtcagattgctgactaaattgtgtactgtcgaacgtggcaaaattgagattgatggaattgatattaacacatttgatatggaatatttgcagacgcaaataggcgttatgactcaaaatagctatttgctggctgaagagtttaataatattctaaagagtgaaaaagaattaaataaaatgaaaaaatttttggaagaaatgaacttttacgaatcaggaaacagtatattaaaaggtaattttgaagtaaaagaaaataatttaaatatatcaggaggggaggctcaaaaattagctctttataagctttatttggataataagccgatttgtgttctagacgagccgactgctgccttggattctaatagtgaagagaagatgatagagtttattaaaaatcattttaaagaaaaaactgtaattattataactcataaaccacaaattttaaaaatttgtaatcggataataaaattggaattgcatgaagggggtaagatgacagtatgaaattaagtatttgggtaactaagacatgtaatatggcctgtagttattgctatgaagaaggacttataagagaggatactggtgtttgcgaaattgattatatcgaaaaaacaatagagtttattaatacaatgtgttataagaccgcctctaaaaaaatattcattaaattttttggtggagaacccttaattaagtttccttttattaaaaaatttgttgagattgcaaatgaaaaaattgatgacaaaatcactcctttttattctataacaactaatggaacattaatgacggatgatatgcttatttggttaaaaaaaaataatgtggaatgtgcattaagtatagacggtgatgaagagatatatagcataaatagacgatataaaaaccgatcatcagcgtggcgcgatgtcgatgatctcattccgcgattgtttgatgcaagtttaaaattgtctgcgagagtgacctataattcaaaaactgtttcaaaacttagtagtagttgtgaatatttgataaatcgtggctttacagtgttgaaagttgtaccagattatttcgattctgaatggagtgacaagtcattggagattctcgaaggacaattaagagaaatagataagataagaaatataagaaagaatgcatatataaacctagatgatgatgaattgtttatcggtagacggggctgcgcgggaggttatagcatgtttagtattgatttgggggggaatgtttatccttgtacatatgttatggatgataaacaatttcttttaggaaatatagaaaacgtttcagaaattgaaccgcgatatacagatggaacgtctttgaatagggaagattgtgttggatgcagatattttaaatgttgcaaaagtgctagctgtttatatggaaattataaaatgacagggtacttgaataaaactaattctttcttttgtggatatagaaagatattgtatcgaataaatgaggaaaagttatgaaaaatatcaatagtatatttttttcgaagtatacgagagtattaataaatggtaatgaatgtattgttggcaatattgcttttgatggaagatggatcaaaatgtcgcattctctttataaagatttggtgcaaaagtctcaaaataatatatctttactatctgaaaaagaaaaaaaatatataaatgcatttcgggaagtaggtatttgcattgataatgcagaaaaggatgagttacaattatatccttcggatataaccattgagataacaactcagtgtaatttggcatgtaaacattgctcgtattcctttggtgggaaaaaatatagagaaatgccaattgatatgataaaagctatttcaaaatggtcggaagacaataaagtgaaaagaatattattaacaggcggtgagccattttgccggaaagatatagtcgatgtatgtaaagtgattaagcagaattttactgggtcattagaaataattacaaacggaactttggtaactgatgagtacatcgagcttataatgaggtatattcatgctttacatattagtttagatggatatgatgaaaacagtgtgagcatgatacggggaaagggtgtatataataaagttattgcattaattaataaactgaagatgtgtgggtatgaaagaattactttatcatgtgtaagtgttggcgatgataattctgaaataataaagttcaaagagttatctgaacgattacatattaagccggttattagacagcttaatataaaaggacgggcagaagaaaattttgcggaggatcctatggaattgcgtattatgcataatctgactgaaaaaggacttacatttaaatgtttatgtaaccatcaatatcgttctatttttattaatacttatggaatagtgttttcatgtgctgcattaagagaggaagaattaggaattggaagttttatagtttcggaacacaagatacatatagacggtttgtttgcaaaacctatagttgacaaaatcgctccatgtcaaaattgtaatgtacggtatttttgtgcggatacttgtatttcaagaaataatgtgatatactcaaacaataaaaaacgtgttgagaggtgtcatattaaaaagaataaattggaaaaaattgtgtggcacactgataatgatttgtaatttaatttacaaataaaattttaaagaagggaggagttatcatgggaaacaaagaaaaagaacttgaagttgaaatcaaaggttatggatgtgacgatgattgcgaacagtattttgagaaaacggcatcaaaagattgtggctggaaagaaactgataatacttggccactgtggtagaaagtatcaggtaaacatgtaaatgagtaagaaatgggtgccctagaagtctttgtaaaaccaatattatacaagccctagaacatttgataaggtgtattttggggttgtagtatgtggtgcgagagacttttagggcattctttttaattagtgagtaggtgtaaataacttcaatgaaaattgctgtgttagatagtgggtttgattttagtcaaccattacagaataaaattactaatataaatttcacagatgaaactaacaaagatgaaaacggtcatggtacatgtattataaaattaattgattcaattagttctggtttggaattgtatagtataaaaatattggatagaactggaaaagggaagctgtcgtctttaaaagtggcactacttgaagcgttaaacagtgacgttaatattattaatttaagtttaggaattgaagcatttattaaagattcggagttagaaattcttttagataaatgtctgtctcaaggaataataatagttacatcagaatcaaataatggaaaaataaattatctttcttgtaataatagaataattagtgtccaaggtaaacaaaataatcttgttaccagtaacaatgttatttatattaataattctccaagaattataccatggttgggatcgtcttatgttttaagtggagcaaatagttttttgactccatttattataaaaaaaatatatgaattattgcagaatcatgtaagtatacaaaatttaaaaaaatgtttaatgcagcaaagttttatatttaatagtaataaaaaattcagagacaatcaataattaatgctaaattaatgaaaagtattgaggaagaaatttctatttggaatttatatgatgaaaataaagcatttaaaatcgcccaggctactccacggaatataacagcacttgttaggataattgaagaaaaaactcaacaatcatatatttatgattccttttggatgccagatttagcttatttagaaaattttgttaacaaaataggatctatacttcactaataatacaatgaaaggtgtaaatatgaacgaaattaaactggataatatatgcttttcggataatacaagaattttaaatcactataatgaaatagttattggtaatgtgagagagtgtggtttatggataaaaattctaactaaagactttgaaaaaataaaaacatacataggactagaaaatggttttgagctgttaatgcggaatacggataatgcacggaagcaatattatattgagattattaaggctttagcaaaaataaaagtgataaaacgtaaagactggagtgaaaacaagaaaactatagaacgattagacattgaattaactacaaaatgtaatttgagatgtaagcattgttctggcgagtatggtgagcaagataaatcttcaatgccacaagagatgtttcatagaatcatacattgggccgcagaaaataatatatcctcagtaacattaagtggtggtgaaattttttgtttgtctaatatttcaaaatatttagaatatgcaagaaagaattttatggggcgtattgatattatttcaaatgctactttaatttatcctgaacatattagtatattaaagtcatgtgtggatgaaattagtattagtttagatggatatgacaagaatagcgtagatttcatacgaggacaaggggtgtttgataaagttattgagactataattttgctaaaaaataataaaattgataacatttcactttctatggttctaacaagtaataataaaaatcatgtaactgacttcaaagaactttgtaataaatttgaagtaaagcctattctaagaacactctctgtaaagggaagagctttaaagttttatgatgacttaattaatgataacgaaaaaggaaaagaagataatatatctaagagaattaacatgttagccatgtgtaatgctggaagtcaaatactttctattaatgcaagtggtaaagtgactttgtgttcagctatggaagagtcaaatgttattttgggagatattgatgaactggatataatttttcatgatgttaaacgaattaatacgatttgtgttgtagatacggttacaccatgtaatgaatgcgatgttagatatttttgttcttctatgtgtcatgcagtaaacacaaatatttacaataataatcagttgaaagaaaaacggtgtgagcaatataaaaatctcttggaaaaacatgtatgggggatttgaaatatattgtgagtactaagtttagcagctgtcaggcaaggaaaagaatgcaatgataaaaatcttaaatagtattaaagaattacgttagaaatagcctttgcagaaaggctattttttatgtatgcgcgccatgggcgcgctctaatgggtgaaaggtcccgaatatgcccaggtagtgggaaatgtatagctgaacagcaagggtgttcaccgtgaggtaaaatctgaaggaagtcgttggcaaatctctggtccgacggacagaaaccgcatacaaggctaggctacgagagataagttggcataaagcaacgaagtctaataactaccacatttgtggtagcagagtaaatgcggtggatgaataaattaaagattgcagtattagataatggtgtagacgaaaaattgcttgcatcatgtggattacccgatataattcagcagaacaaaggaaatatcagtgatgaggaggatttgtttctgcatgggacaaattgtgccatgatcatagggcttaattgtgccgacgcagaattatacagttataaactgcttgataatacaggaaaaggaaatgtggatgatctgaaatcagcgtttgactggtgtctgatgaacaatataagacttgtcaatctgagttttggaactacacatgaatattccagatggttttacatcagccgtccggtgatatggaaatcactttttagatccgcttttgtgcataccgaatcataatttctgctgagacatttgtaaagactgctacgcaccgcagatgcggcaaggtcttgacaaatatcccaacagaaatggataagtcatcaagcacaaaataggcgatttccgagtaccggaactctgatttccaaatttccggaagtgcgatttcatcgcacaagaatattcaacacattttaaggacaaaggaataattcggcagttggtaaatcaatatgccaataagggacttatcataattgcggcaactgctaatagtgggtatacggcttttccggcatccttttcaaatgttatcggagtaaaagcaaaagatacatttaacattgatgcggaaggtttgcgggataaaggtgtggattttgcagctccatcggaacacaaaatctggtttggaggaaacgatataacgcttcagaaaagtaacagctatgcggcaccttatgtaacagcaatggctggaaggttaatgatggaacagtcatggatcaataatgtatggcagattaagaagcatttataccagaaattcaggggaaaatgtgtacaatatattccggattggatagaaaaaggatggattgccggaaaggtattaaagagtaaggaagaggtttattttgaggtagctgcaaaggaagaagcagacactgtaattttgtatgataaaaatgagtttaatgaatacagggagaagcacattgtgtatcttggcaatgaaatagcagagcagccggatacacagtgctttttctggagcagaagaaacagaaaagaacagatcttatgttcaaggataaagaaggagaatattaatatacctgtcatacttttaaaaagtggtaaagaacaggatcagatatggtggcttacggaattaagaaagagttttgaagcggagggctataatgcatatgctatttccactgaacaggagagcgtattgtatgatttagaatatatcccttttgctgttgatgaaaatataagtaataagattggtgatttcctgtattggcagacttattacaaccagtctgatttgattatttgtggaatacaggaaaaagaaagtatcggtgtggaagccgatatatttgtaagaatagaaaatgggaagaagcagacaggaatacaaatttattgcgacaaaataaaaaaggcgcagatgtgttttggaaccctcggagagcagcagataaaggaagtatatgattgtctgcttacaatcctgacggaggatgaagatggggaataaagaagcagtaaagaaactgctgggaatgttaaaggggtatagaaaaataattgctctgattattgcatgtctgctcatttcaacaggattgaatatgtgtatcccgttactaagcagggggattatggattatggtttcataggcggagataaagaactgcttataaaacaggtaataggttcactgcttatctatatgatgatagcagttattgatattataaaagaaaagaagcgggtagatatatctgcgaatatacaatattctttatcggaacagtcatttcaacgtctgatgaggataaaagcaaactatttcagcagtaaaaattatgcggaaatcctaaataacataaatatagatataggaaatatgacttctgttgcagatgagggtgtgttttttgttgtcactcaggcattcagtatggtaggtggaattatcggactttttatcttagattacagaatgacactcatggtacttctttttattccggtaaaagcggttattatgaaacattttgcaaagaagcgaaaaagaatcatggacgagtttattacagaaagcgaaaaatatgccggatggtttggagatactgttggcggtgtaagggaagtaaagctttttggaatacaggaaaataagagagccgaatttgctgacagacagctttctgtaatcaataaacagaaaaagatgaatatgcttgcccagtggaacggcataacggataacattatcgtacatctgctgaccagcttgatatatattattggcgcaaatcttgtttttgatatgcagctttcagtaggcagtgtgtttgcgtttattacatatagtgcgtatgtgacaggacctatttcagcaatactcaatatcgggtatcttttgtcaggaattattccttcaacaaagcggtattatgagtttatggcacttgaagaagaaaaggaaaatgaggagggcatgaccgagccttcttcggtgatctggaattacagaatctttctttttcatatgaaaaggataaagcggtactgtccgatattaatattgcttttccaaagggaagtaaaacggtgctgattggtcggaatggttcgggaaaaagtacactgataagtctgttgctgcaattataccaacctacaggcggaaaaataacattaaatggtatagatatttcggagtttgttttgagagaatacagaaatatggtatctgtagtaagccaggagatctatctgttcaattcatctatcagggataatatctgtatgtataaaaatatagatgataagacaattatggaagcctgtaaagatagtggacttgctgattttatttctgaggtgtcattggattatgtggtaggacagaatggggcaatgctttccggaggacagaaacagaaaattgcactggcaagggcattggtgcataacagtccggttattatatttgatgaagccacatctaatacagatgtgtattctgaacatcagattaacggactgctccatacgaaactgaaagaaaagacggtcataatcattacccacaaacaggagatattaaaagaagcagatcagattatcatgctgaaagatggtgctgttgttggaagtggagtctatgatgatttgtcaaaagataatctggaatttaaaaatattgaataatacattgccatgaattgacaggagatagtaaaatctgcaaagtattacacgaaaatggcaaatggttacagattgccagacaccataataatttctgatataatgcgataagtcagaaaggatgatggggctatggggaaacgagagcacatatacaaaattattgcagagaatatcagaaaagaacgaagaaggcttggaattacgcaggcagagcttgcagaacgggcggatgtatcattggatactatcaaaagtgttgaaaatggcagaagggcaatgagtcttgatacatatttgaatattgttcatgcattggagtcatcgcctatggttctgatgagccagcagcaccctaagaagcacattgagcgttttgcatttatgatgaatcggtgcgacgaaagagaaatagaatttgcattacatatgattgaacaaatattaagaggacaggaagattatctgagtgaatagacgggtagttatcctgtcctttgtctatgactcttttgcaaatttttcagcgagatggtatatgatttcttcaatggtgggagtatcattttcacatggaaagtctgtccagaagcgttgcatttgtggatcagggctttttaaagcaatggaaactgcccgcccaatttcctgttggacttcttcttttgtgattccttctttttcggcaatgatttctaaatatttatcaacagagtatgtgcttttatcattcatagtgttgttgtgaatcctttctgagaagggtatctacgggcaaattgtcaggtgcttgaattgtcccggttgaataccataaaagtaaaacagataatccgttctatattacataataaccttgagagctgttttctatgcagcttatggctattttctattctatcatatacatacagtacggtgcatacacgcaccatatcattataggacactcttgcgtagaatacaaggaggaggtctttgtaatgatagtatatgacaggttatggatcacactcaagaagaaaaatattagccagtatgcactaattaaagattatggaatagataaagcacagttacagcgattgcgaaagaatatggtcgtaaaaacggtaatccttaacagattatgttccatacttgattgtaagatagaggacatcatggagtttgtgccggatgaggatattaagtaaagagatatttccaaaatgtaatgagagtttggaaatatctcttttttaatccgcaaatatttatattcttggtattaaggtgtacaatattccacctgaaatagctggtttagtcactcttacaaaagattcgcttacggtacaataaatatagcttaagcaaatatataaggtgccggaaaagagtggaaggtgtactacgatattgttaatagtggagaaagaataaaagagttgcgtgcggcaagaagaatgacaagacagcagcttgccgagcagattggattgtcagtggacgctctgcggaaaattgaagctggtgtaaatggagcaaaaatagatacgctgattagtattgctgaattgtttcatataacgttggattatcttgtgtgtgggtgtgaaagaaaggtagaagtcgatgatctgctggttggtctgaaggagaaggaagtacagtttatccggaatatggtattaaatgccgttgacaatatgaaacttctgacagaataaaaaagtcggattgcatttttgatgatgcagtccggctttttttataaggatttggaacaggtgggagtgttactcttagttcaaaagagtgtcggttactgtagaagatgcgtggtgtcagttatactctgttcaggttctgagaaaagaaccgttgaatattgaaaacagaataggacacgcatattccacgagcttatatcgccttgtctatgacagggtggcagaatcccatttcgtgcgatgactatcctcagagctgtagccgattatgagaaacgtaacagcaggagcctttaaggataagagcagagggttgtgcctaccgggttagcagccggaggtaatgagataataagtgcacctgaatttcagcgaaatgcattttcagagagtggctactttcgtaagtccagatgggcaggaaactacgaagtgtttgtggctggcaaaggatatgttacccgatacggggaaggttgagaaaccgggaagatagtattttatcttcccacacaaactgatttgcagtaaccagcagacaacaacggggcttataagtgcagagagcattggcaggtcagtttatgtgaggagataaagtgtgcacaggatatcaaatcaaaataaaaacaggaatggagattttaaaatgaataaagcagttatatattttggagcaacaggaaatgaggcagcggatcagatggtaatgcaggttcttgaggagtattgcgctgtgaatggatatgaggtggttgcagttatttcagagaacgcaagaccggagggaatgacatttcctatgaagtttgcctttgtcggtatggcagaagtagaagatgttgatgtggttgttacttttatgagtgatatggtgggcgattgtgaagaaacaattatggataacatcattatgcttggagagcatggcattacggttgagacagcaaacgatgatatggctggatattatcagaagatggagcaggcagggcaaaaggaagataacggcattgtttcacttgctgattttatggcagtatttttcagacgtctcagagccaacagataggaggttttatgagtaagtgttgtgttatctgtgtaggcaggaatgccgacagagccgcagacaggatagaagcatatgctaagaaagcggattttgagattgtagaaacaatctttaaagatacgaagtctgtggaaagacttaaattttatatcgaaagagattccattatcagtattctggtaagcagtatctatgatatttcatcggacaaagatgtggtaaagggtattatggagcttgcagcggagcacggtatcagtattaatgacgagagcaggggctatgaacctgctctcatctcgtttgaggaggataatgccggataaaaaggaattaagcatagtgacattttcatcagaaaccgtggtgtttgatgggaaaggagacagagttgttgcctgccctacggaacaggaagctgtcgaatatatccgtgggcaggaaataccagttgacagacaaggaagtgaatattatgagtgaaataagacggggcgatatctggatggttgattttggagtaccggaagatgagaatgaccacaagctgcacggtatcagaccagtagtgattgtgagcaatgacagtgcaaacagacatagcacggtattccatgcagtaccgcttacaagtaagattcataaaaagacatatctgccaacacatatttttatcagttcgtttaaggctgttggattaagaacgaacagtatcgctcagtgtgagcagttatgtgatgtgaaagatacggacctgatagaaaaaatcgggaaagtaagcaaaaaccagttaagacagataacaaaaggtatgcagatccagttgggtatgagtacaaaacataataatccaatcgcataaattccagccggggcgaaagctccggtgttacatagccgtcagcatatctggtggcttaatttgattggagggataggatgacagttgaacagttggacaaaatatcggcacagagattagaagatgtggatattgatacattggtggaagtaaacagcataaagtacgctgacggaatgcctgtggaaaagaaggttgcgggaatgattgcaaagacaggtaatccgtatttccgcagatcaggaaagagcaaaattaagatttcattttctgataacggggaaagcctgaaagacaattatattgctatgcttgccaatgtatagagcagtcagccaaaattaggggtggaaattcagatggatttgtgatatcattacagacaaataaggacatctaacccgaaagggtatcaatttcatatttatgtttccattcctcttgatttgggacttctaacttagaaaatcgaaggagtggtggacatgaacaattctaaaagaatttacagagcagccatctatgttagattatctaaggaagatggcgatcttgatgatgtgagaaaagctgaaagtaacagtatctcaaatcagaaatccctgatacttaattatttaaaagacaaagaagatattgaaatagtatcaatccgtgaggatgacggctattcaggggcaacttttgaccgtccggcatttaaacttatgatgcaggatgtgaaagacggtattatagactgtatcgttgtaaaagatctttcgaggtttgcaagagagtatatcgacgcagggagatacattgagcggatgtttcctgcaatggggatacgatttatagcgatcaatgatgcctatgacagtgcagatacacaggcacagggaaacgagataatcattccgtttaagaatcttatcaatgacgcttattgcagggatatttccataaaaatccgaagccaccttgaaacaaagagacagaacggagaatttgtaggaaattactgtgtctatggctacaagaaatctgagattgaccataatgtgattgttcctgacgaatatgctggtccggtggttcaggatattttccactggataaagaacggaatgagccttgatgccataagtgacaagctgaatgctcttggtattctctcacctatggcatataagctcagcaagggagagaattataagacagcatttcagaagaaagacgagctgttgtggactcctgttgctgtaaggcgtattgcaacgaatattatttatacaggaacgcttgtacagggcaaaatcacaacacctaaccataaggttaaaacaaggatattaaagccacaggagaaatgggcagtatgccacaacaatcacgaggcactggtatctttaagaacattccagattgtacagcgtctgttgtcagtggatatgagaatggcaccggggaaagactctatctatcttttatccggaatagcagtatgtgccgattgtggagcacttatgacacgaaaggtgtctacggtaaatgggaaaaagtatgtttactatatgtgttccaataacaagaagaataagaagtgcagctcccacaggataaaagaggcagacttggaaagccgtgtatttgataccttgagggaaatgacagcaacacttctggacgctgatgaagtgataaaggaagctggcaacaatgccaatttcagaatagaccagaaaaagacaaaagagaggatcagtgcaaaagagaaagagataaccaaatataatcagatgcttgtttcactttatgaggactacaaagatggaatcgttgataaatcagactttgcgattatcaaggagagctttgaagtaaaaaggtctgaagcggaaaaggcaatcgacaggttacagaaagaagcagaaaacattgctgccggaattgaaagagataccgagtggctggaagaacacaggaaatggaaaacaatgccttctcttacccgtaatgtggtagtgagccttatacagtccgtaaaggtatatgagggcggtgatatagaaatcgtactggattgtgacgatgaatacaggaaaatcgttgcaagagccggggagctggaaaaacagcaggatacggaaaggctggtggtctaaatggcaaggaagtcaagaacacagccgaaacaatcaccggatacactgaatgtattatccaaagtgtataaaactgccatatatgtgagattgtctgcggaaaaagatgaaacgagagacagaaaaaccctgatcaatcagagaaatctcattaagaactttgtggatcagcagatggatatggaaatccatgacatctatatggatgatgaaatttccggtacaacattcgacagaccggaatttgagcgtatgatgtcagatatgagggcaggaaggatcaactgcattgtcgtaaaggatttgtcccgcttgggtagagattacattgaaacgggcaatctggtagagcgtgtattcccgatgatgaatatccgctttgtagcgattacggataattatgattcctcaaagaaagacgcagaccttatggttgcggtcacgaatatagccaatgatctgtatgctaaggatatttcaaagaaaatatcttccagtaagcaggaagcgatggaaaaaggtattccagttggcagagtgacttatgggtataaggtggttcttgatgaaaacaaagtcagggtaatggttgaggataaggaagccgcagatgttgtaaggtggatttttaatgaggcagaaaaaggtacactgcattctgtgatagcggcagaactgaatgcgaagcatatccttacacctgcccagtacaaagtaaggcataatatagagaaacttgaaaagctgcgtggagttaagtggactgttgatacattgtcacagattttaaagaatgaagtctatattggaagatatgtgacaggtaaagacagggtatgcttgtacagacacgaaaagaggcatactaccaataaagatgagtggtatgtttttgaaaatcatcatattgcacttatcacaaaggaacagttctatgcggtgcagaagaacaaaagaaaggtaataaagccagcaaaaaagcagaccgtgaatatgctgaaaggcaaaatcacctgcggctgttgtggaagcagtatccatatccaccctgagaaatatggaaaggtttatatgtgtacgcatagaaaaagatatggaaaggacagttgcaactgcctgcctgtaaaggtagacgatatatatgcagcggtgcttgctgttataaaggagcagatacaggtctttattgacagggaaaaaatattaaaggaacatcacaatgacagcagtgtaatcagacaggaacaggtatatacggaagctgtgaataagtgtgtcaaggaaatggacagacttatggaattaaagagcggtctgtatgctgattacacggaagatttgcttgatgaaaaggaatatctgcaactgaacagggagtattcacagcgtattgagaaattgaagatacaggctgatgaatacaggcaggcggcaagtcagtatgaaagtgctgaaaagaccgttgcccagttaaaagctgaaatgctccgttttaaaggaaaacgcaagttgacgcaggaaatggtcgatttgtttgttgcacaggtacgcatatacgaaaacaagaatcttgagatcgttttgaactatgaagatgaactgaaaaaattcgcagaactgaatatggaaagagaggcaggataatggctgagaaaagaaaattagccttttatatccgtctctcggatgcggatgaggaggtaaaagaaggaacaaaagacgaaagtaacagtattacaggacagagaaaactcttgtatgcgtatatcaagaaaacagaggaatttgcaggttttgaggtactggaatactttgatgacggatattcgggaacaatgttcaataacagggcagaattccaaaggctcatacaggacgcagagcttggaagatttgaatgtatcatagtaaaagacttttcacgatttggaagggattaccttgaagtaggcaactatctggagtttgtattccctgcaatgggaatgaggtttatttctgtcaacgataattatgacagtgacagaaactttggtgttaccggaggaatggatgtagcttataagaatctgatttaccagctttacagtatggatttatcaagaaaggtaaagagtgccagaaggacaagaaatctgagcggcgaatacacggcatcatttgtctgctatggatacaagaaagatccagacgataagcataagctgataatagatgaagaagctgcaaaggttgttgtggagatattttcactgatcattgcaggatataatgcaagtgaggttgcccgcatattaaatgagagaaaaatcccgacaagagttcaaaaccagtggaagaatggaatcaattatgttccggttcataataaaggggattatatgtgggataattcagaagttatagcgattgtccagaatgagcagtacaaaggaataatgatccagaataaatgtgaaactgttggttttggagataataagaaggttcgcaaacgaaataaagaggactggtctgttgtagaaggtgcaataccaagaatagtaagcgatgaaatgtttgatgaagtcaataaaatgctacgggttgaagccagagggattgaaaagagtacaaagaaacgtaagaaaaatctttttatctgcccctattgtgggagaaagctgatgaattccagtgcagtatgtacaccgaagctcctctgtccaaaacgcaggatggtaaggactggcgaatgtcagcagatttttatgctgaagtcagaagcacaggacaaggtgctggaaatcacaaaggaaatctgtagaacacttatacaggaagaagaacttaaaaaggcatcaaaggataaaaggaaggtgacaagcgatgagtatttgattagtgagcttaaagcggagtatgacagaatatcaaacagcacagtttcttgttatcagtcatacagagagggaaagtacacaaaagaagaatatgtgcagttaagaaaaacaaaccaagagctgttagctgatctggagaatcagatatcagatttgcaggagaaagttgcaaatcaggagcctgacgcagaggagaagatagaacagctaacccagtatagtatgctggagcagtatgacggagatgtactttcaaacataattgataaggtgctcatttacaacgacaaagatatagaagttgtgtttaagggtgagaactttatccgaaatgcagtgtagtaaacaaaatgagtaatatagaaagccagtagtgaaaaagctgctggcttcttctatgggtaataacgaaaaggttaatagtaataaactattctgtactttaaaaatcagtaagggtttgatagaatatgtacagaaaaaaataaaattttttttgtcccagtcttgacagatgcaggattcccgatctggtggtacgttgcgccgacgatcatcaacacgttcctggagagctatgatttttccggaaagacggtgatcccgtttgcaacatctggcggaagcggtatgggaaaaacagaagcagtgctgcatgcactctgcccggacagcgtgaactggaagagcggtaagatgttgaacggatatgacagagcgcagatggaggcgtgggtcagaacactcgcctagttctgtgaaaaataagaaagaccggcgatttgtgtcgcaataagacgagcggtttttgttgtacggaagaatcgatacacctataatataagttaaggaattacaatataggagggtgtatggaaaaggtacgttatatgatttccgatgcggcaaatatcgtccacgtcgaatcacatgtgttacgttactgggaagatgaactggaactgaatattccgcgcaatgagatgggacaccggtattatacgaaggaaaacattgcggaatttcagagaatcaaggaactaaaggaacagggctatcagttgaaggcgatacgcatgattgtacataacggaccgatcgaggggctgacggcagaagcaccgattcccgtgggacaggcaccgctttctgcgggagcggccgctgcaatcccgcagccggtacaaccggtcgcggcacagccggcagcagtggtacagccggtgcagcaatccgtgcagccggtgcagtccgctgcaccccagcagcttccggtaaaaacgaccgccgagagcccgcagagtattctaaacaatacggataagatggcacagttcacagaactgatgaccgagatagtgggaaaagcgcttgccgccaacaatgaagaactggggcaaagcatcagcgaggaggtaggaaaacaggtgatcaaggagatgaattacctcatgcgggagcgggaagaggcagaggaggaccgcttccgcaggctggatgctgcgatccgtggaaatatccgcaaaaaggacgaacagaaagaaaagaaactctggaaaaagaaaaagccgtcacaagcgtgacggctttttgctatgtacgaaagattaaccctcgctgatagctcctgtaggacaaactcctgcacatgttccgcagctaacgcaggaacctgcatcgattacgaactggctgtctccctgagaaatagctcctactggacattccggctcgcatgttccacagcttacacaagaatcagaaataacgtatgccattttaaattccctccttaatttgtaatcaaaacccggctacccttatagataacctttaagacattctaatacaaaaatacacggctttcaagtcaaaaaagccgtgtacttaaattagcacataatgctgttacgaaatatattccatgctggagcttctgctagaatgttgaaaaatgatacagtgtcttggaacggaacggctcatccggtgtcagcacgatgctcgggaaattgtcatggttgatcgcgtccggaaaatgctgtgtctcgagacacacgctcgtatggcaggcatattgcgtaccgttcttgccggtgacctcgatcggctggtttgccacatacagctgcatacccggctgatcggtaaagcatgtcatgcggataccgctctcctttgactggagaaccgctgcctcacggaatccggtgccattgatgacgaaattgtgatcgtaggtgccgaacttgtgatactgctcgtagtcggaatccatcagttttccgatggtgtgcatggagcggaaatcaaacggcgttccctctaccggaaggaatctgccggtcggtgcctgtgagtcatcgagctctgtgatctgatcggcgtcaatgaaaagctcgtgggataaaacctcactggagccttcaccgttcagattgaaatagccgtggctggtaacgtttaacagcgtatccgcatccgtggaagcttcgtagagaagggacagctcattgtcctccgaccagccgtaggttacggaaagtgtgagattgcccggataaccttcctcgccgtcgtaggaattcatggttaaaatgagtttgtcatccttgatctttgcgtcccagggcttggaagcgtagccgatcagtccgccgtgcagatggttggagccgttgttgatggcaagctggtattccttgccatccagacagaaatgaccgtccttgatacgattggcaacacggccgacaactgcgccgaggctggcgttgtcgcgcgcgtaatcttccatggaatcgaaaccgaggcagacgtccgtcatttttccgtcgcggtccggaaccacgatctttacgagacggcagccgaaattgatgacttccacataagcgccgtttgcgttctccatatggtatatataaatattttctcctgtgtttaatgtgccaaaatctgactttgtaatcttcataggaaactcctttccatttatatcaggacaaacctaacgcagataattatgccacatttgcaaaaacatggcaagtgaattgccctattttcggaagaatgcccatagcgggcgaaatgtcaaacttgcctaaatcgtgaaattatgcaataatgttcacgaaagcgaagcggtcatgcacgcactgtaaagcaggtcaggagacagtgcatatgacggccgcaaaggcacaacagttgagaggcgaataatatgcagacaaaggttgttaagatagattctgcgaatatagacgatgcagccatgaaagaggcgtgtgatctgatccgcgcgggagagctggtggcatttccgacggagacggtatacggactgggggcggatgcgctgcacccggaggcatcgaaaaagatttatgcggcgaagggaagaccttcggataatccgctgattgtacatatttcaaagtttgaagatctggtatcgatcgcgagggaggtaccgccgcaggcgaagaagcttgcggacgcgttctggccgggaccgcttaccatgatcgtatggaaaaatgacagagtcccttatgagaccacgggcgggatggataccgtggcaatccgtatgccgaagcatccggtagcgctccggctgatcgaggggagcggatgcctgattgcagcgccaagcgctaacacatccggcaagccgagccctaccgaggcgtcccacgtggcgcttgatatggacggcagaataccgatgattctggacggagggccggtcggcatcgggatcgagtcgacgatcgttgatctgagcgagtcgacgccgatgatcctgcgcccgggatatatcacacaggagatgctgcaggaggttctcggcgagaaagtctgcatggatccgggaattattgcgtcggattccaccagaaagccgaaagcgcccggcatgaagtacaagcattatgcgcccaaggcggatcttgtgctggtggagggcgagacggacaaggtcgttgccagaatcaatgagctggtcagagaaaagcagcagctcggacagaaagtcggagtgatcgctacggatgagacgtttttacgctacgaggcggatcacgttgtcagcatcggcgccagggaagatgaggatgccattgccagacacctgtataagatcctgcgcgagttcgacgactggaatgtggatgcgatctactcggagagttttgccacaccgcgcatcggtcaggcaattatgaaccgtctgctgaaggcggcggggcatcaggtgattccggtatagctacatcagggagagggcagacatttctatgagacaatataatcgaatcatatttgttgcagaaagcggcacctgcagagcacctatggctgcaggaattctgcaggaatgcaatttaaaacatccggtggaaatacttgccaggggactggtggttttatttccggaaccattgaatcagaaggcggaaactgttatgataagcaatggtatcaatatggatggattcatgtccacccagttgacggaggaggatttttcggaggatgcgctcgttttagtcatggaacacagccagagagagaagattctggaaaagtacgggcacgccgatccggagaatgtctatgttcttacggaactggtaggagacgaacttgagatcatcgatccctacggggggacgcttcaggcgtacggactctgctatgagacgatgcgcaagacgatcttaaagcttgtgaacctattgaatgaaagtgaagataacggcacagactaggctctgtgtaagaagggaaggtacaaaaaatgtcaaaagtagtagttatggatcacccgctgattcagcacaagattggaattatccgcagggaggagaccggttctaaggatttccgtacactggtcagcgagattgcaatgctgatgtgctacgaggcaaccagagacttaaagcttacagatgtggagattaacacgccgatctgcaagaccacggtcaaagaattaaagggcaaaaagcttgccgttgtcccgatcttacgcgccggactcggcatggtggacggtatgctcaacatgattccggcagccaaggtcggacatattggattataccgtgatcctgagacattagagccggtagaatattactgcaagcttccggcagactgcgcaaacagagaggtgtttgtggtagacccgatgcttgcgacaggaggatcttcggttgcggcgattcagatgttaaaggataaaggcgtaaaaaatatccgcctgatgtgcattatcgcagcaccggaaggtgtgaaaaagatgcaggaggcacatccggatgtggatatctacatcggcgcgctcgacgatcatctgaacgagcacggctacattgtaccgggactcggagatgcgggagatcgtattttcggcacgaaatagaatctgtttgatgcggcggacgcaggtgggagtgataggaacatgagcggaaaacgtacagattatatcagctgggatgaatactttatgggcgttgcgaccttgtcggggatgcgctccaaagatccgaatacacaggtgggagcctgcattgtcagtgaggagcacaagattctttccatgggatacaatggctttccgacgggctgttcggatgacgacttcccgtgggcgcgcgagggcgaaccgcttgagaacaagtatttctatacgacgcacagcgaactgaatgcgattttaaattaccgcgggggaagccttgagggcgcgaccatgtatgtcacgctgtttccgtgcaacgaatgtgccaaggcaatcatccaggcaggcatcaagcggctggtttacgacagcgacaagtataacgggacgccgtcaaccatcgcgtcgcggaagatgctctctgccgcaggggtggatatacagaaatacgaacataccggcagaaccgtcacgattcagctgtagaaaaaggacttttggagccgccagagatggcggctcctttttgtcattaggctttagcctgctgaatgcgtgtttacgagtttctcaacagagaaacgaagtacgcatgaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaaacgacaataaaaaagtatattcaagatcaagaaaagtacgatattatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactgtcagtaaattccagaatatccatttatttttaaaacagtttctttgcgtcggttgatttttctttacaaatcttttatacttataaaagaatttgttatgggaaaaataataggcaatggttgcagcagagactgcggtacggtgaggatttatatgaaaaatcagcgaaaggttttccagtctttgacactgattctgcagtttggactgaacatgatcgtgccgatcgtgatgtgcacgctgctcggtgcgtggctggggaaaaaatacggaatgcccatcataacagtgccgttgtttatcatgggcgcacttgccggatttaataatatatttaagatggctaagaagatctacggacagggagatgaggggaagcgggatcatgttgagaagactaaatgatgcattgcccggtcttgttctgggaattattgtatatggggcggcggtttttctggcgggaatctggttcgtgccggacaagctgcgatttactaccggacttgccataggcattgcccttgcctgcgggatggcggtcaatatggcggtggttctgcgggatgcggttgagatctacggggaggcgaaagcccggtcgaagattatcgcccggtccattaccaggtatctggtggtcgtcattgtgtttttcgtgatgatgaagtgggagcttggcagtctgccggcagcatttattggtgttttgggattgaagatatcagcgtatctgcagccccttgcacatagattcatttcaaagcttggaggaagaggtgatgtgccttcggacagcagagaaaatgaagctctataaggaggtgaaattgtgaataacgcaattttgatgtcttctggtgccgataatattgacttcatgatacatgggattttttcctatgagatctttggtcatacggtctggattacaacatcgcatgtctgcatcctgattgtgctgctgctgatgttggggctggcgatcgcggcaaatcggacgatgaaacatgcaaaggaaattccggagggctttcaaaatgttctggagatcatggtagagaaactggatgcgatggtatatggaacaatgggaaaagttgcggcgccgaaattcgtgaactacatcagcacgatttttgtgtttatacttatgagcaatatttccggtttgttcgggttgagaccgccgactgccgactacggcacaacgctggcgttaggtctcatcacatttgctctcatccatatcacgcagttcaagaatctgccgcctaagcagatctggaaagatatgtgttctccactgccgccgtggctgccgatctggttcccaatcaacctgatcagcgagatcgcagtaccgatctctctttccttacgtatgtttgcgaacgtactgtcaggaacggtcatgatggcgcttgtatacggactgcttggcaagatagcgattatctggccggcggcgcttcatgtatactttgatttgttctcgggagcaattcagacatacgtattctgtatgttgacgatgacttacatcagtcagaactatgagacggaatagacgtcgaaaccaaaaagattattttaggagggtatcagtatgaatatcacaggagaagatttaattttagcatgctcagcaatcggtgcaggtctggcggttatcgccggtatcggacctggtattggacagggtatcgcagcaggacatgcagctgcagcagtaggaagaaacccgggtgcaaagggtgacatcatgtctaccatgttacttggccaggcggttgcagagacgacaggtctctatggtcttttgatcgcaatgctcctgcttttcgtaaaaccgttggtataggaagagacggagagaacgaatataacggaaaggaggccggaccttggaagagatgaccagactctttaatctggatttccagctgctccacgatgtcgtgctcatggcgattgcggtatttttcctgttcatgatgatgtcgaagctgctgtttaatcctgtcagaaagatgcttgccgacagacgggaaaagattgccggagagttgtcggatgccgcgaatgacaaaaaagacgcagcggcgttgaaggcggattatgaagccagattgaagaacatcgacaaagaagctgaacagattttaagtgaggccagacagaaggcgcagaagaatgcagcgcgtatcgagtccgaagcgaaggaagaggctgcccgcattatccagagagcgaacgaggaagcagagctttccaagaagcgtgcgatggatgatgtcaaacaggagatgatcacggttgcatccatgatggctgcaaaagtggttgcggcaaatatcgatgcgtcggtacaggatgcgcttgtggaagagacattaaaggaaatgggtgattcgacatggcaaagctagtatcaaaggtatacggtgatgcactgttcgaggtcgcagtggagagcggcaggctggatgagatctgggagcagaccagagccatgcagaccgcgctggaggaaaatccggagcttttcgcgctgatgcgtcacccgaagatcgtaaaagaagaaaaagtaaagatcatcgaatcgatttttaccgacgaggtgtgtgcagaactggtgggacttttgcgcatgattgtggaaaaggatcattttgcacagatcgggaaggttttggcgtattttgatgatcaggtcaaagaatataagagtatcgggactgcatatgtgacgactgcaatggaattatcggatgcgcagaaggcagcagtggtgaaacgcttattagagaccacaaagtatgtaacatttgaaatgcattatgaagtggattccgcgatcataggcggaatgatgattcgcattggcgatcgtgtcgttgactcaacggtcaggacaaagttgtacgatctgacgcgcgaattatccaaaatacagttgaaagcaggtgaatgcgctccatgaatttaaaaccagaagaaataagttccgtcatcaaagaacagatcaaacggtatgcagcgcagttggaagtagctgacgttggcaccgtaattcaggtggctgatggaatcgcacgtattcacggtcttgacaatgcaatgcagggagaacttttggagttcccgggcgaagtatacggaatggtattgaacctcgaggaggacaatgtgggtgccgtacttctcggttcccagaagaacatcaacgagggagatacggtaaagacaacggggcgtgtggttgaggtcccggttggcgatgccatgttaggccgtgtcgtaaatgcattgggacagccgattgacggcaaaggaccgattcagacatcgaaatatcgtcagatcgaacgtgtggcatcgggagttatctccagaaaatccgtagacacaccgttacagaccggtatcaaggcaatcgattccatggttccgatcggaagaggacagcgagagctgatcatcggagaccgtcagaccggaaagacagcaatcgcgctcgataccatcatcaatcagaagggacagaacgtaaagtgtatctatgttgccattggacagaaggcatcaacagttgcatcgatcgttaagaccctcgaagaattcggcgctatgtcttacacgaccatcgttgcatcgacggcgagtgagcttgcaccgttacagtatattgcaccgtacgccggatgtgcgatcggtgaggaatggatggagaacggacaggatgttctcgttgtgtacgatgatttaagtaagcacgcagcggcataccgtacactctccttgctcctcaagagaccaccaggacgtgaggcatatccgggagatgtcttctacttacactcaagacttcttgagcgtgcagcaagactttccgataagctgggcggcggttccctgaccgcgcttccgattatcgagacgcaggcgggcgatgtatctgcctatatcccgaccaacgtgatctccatcacggacggtcagatctatcttgagacagagatgtttaacgcaggtttccggccggctatcaacgcaggtctttccgtttcacgagtaggcggttctgcgcagatcaaggcaatgaagaagatcgcggcgccgatccgtaccgagctggcacagtacagagagcttgcagctttcgcacagttcggttccgagctggatgcggatacgacggagaagctgacgcagggcgagcgcatcaaggagatcttaaagcagccgcagtatcagccgatgccggttgagaagcaggttatgattatctacgcggcaaccaacaaatatctgatggatattccggttgcggacatccttccgtttgagaaggcactgttcgagtatgtggatacgaaatatccggaggttccggaagcaatccgcactgagaaggtaatcagcgaagagacagaagcgaagctcataaaggcaatcacagagtgcaaggcagagttcacaaagtagacggcagaaaggcggtgtgcgtattatggcctcgatgagagacataaagagacgtaagagcagtatacagagtacacagcagatcacaaaagccatgaagctggtgtctaccgtgaagctgcagaaagccaagaaccgtgcagagcagacgaacccgtatttccagtatatgtaccggacagtgacttccatgctggcgaagtccggcacgatcaatcacccgtatctcaagaagggtgagagtgacaaaaaagcggttgtggtcattacttccaaccgtggacttgccggaggttacaactccaacattgtaaagctggtgaccggaagcgaggacatcacgacagagaatgcgaaagtctacgccatcggtaataagggaagagaagctctggagcgaaagggctatgagattgcagcagatggatcttcgattatggagtccccgtcctatgaggatgcggcggagctctgtaaacagattttaaaagcctatacggacggagagatcggagagatctatcttgcgtatacgcattttaagaatacggtgagccatgagccgaagctcatcaagcttcttccggtggagttcgacgaggacgagatgcggggagcggcggatgagaaggtgctcatgaattacgagccgaacgaggaagaagcgctggatatgatcattccgaagtatgtcaccagcctgttttacggggcgctggtggaggcggttgcgagtgagaacggagccagaatgcaggcgatggattctgcgaccagcaatgcggaagatatgatcagtgatctgacactcaaattcaatagagcacgtcagggctctattacgcaggaactcacggagattattgcgggagcttctgcgatatcctaggaggcagcagtgcaaaaagttccggcgccggatggcggtggaagcgcgaagctgcatagcaggatttggtgatagaaaataacagacaaggagaaatagcgatggcaaataatagaggcagtcaggattgcccgggtaagattacccagattattggtgccgttctggatatcaagtttccggaaggcgcgctgccggagatcaacgatgcaatccgcgttccgttaaagaacggtggtgagcttgtcgttgaggcttcccagcatctgggtgatgatacggtcagatgtatcgccatgggaccgacggacggacttgtgcgcggtatggaggcaatcgccacgggcggaccgatcagcgtgccggtcggagagaatacgctcggacgcatgttcaacgttctgggtaatccgatcgatgagatcgacgcgccgaaggatgtcgagcactggccgatccacagaccggcaccggcattcgaggatcaggcaacgtcgcaggaaatgcttgagaccggtatcaaggtcgtagatcttctctgcccgtatcagaagggtggtaagatcggacttttcggcggtgcaggagtaggcaagacggtattgatccaggagctgatccacaacatagcgacagagcatggcggatattccgtattcaccggtgtaggtgagcgtacccgtgagggtaacgatctctactacgagatgaaggaatccggcgttatcgataagacgaccatggtgttcggacagatgaacgagccgccgggagcgcgtatgcgggtggcgcttacgggacttaccatggcagagtatttccgtgacaaaggtggaaaggatgtcctccttttcatcgacaacattttccgttttacacaggcaggttccgaggtgtccgcactcttaggacgtatgccttctgccgttggctatcagccgacgttacagacggagatgggtgcgctccaggagcgtattacatccacgaagaacggttccatcacatccgtacaggcagtctatgtaccggcggatgatcttacggatccggcaccggcgacgacattcgcacatctggatgcaacgacggttctggatcgttcgatcgtagagcttggtatttaccctgcagtggatccgcttggatctacgtcgcgtattctggatccgcgtatcgtgggtcaggagcattttgaggtggcgcgcggtgtgcaggagattttacagaagtacaaggaattgcaggacattatcgcaatcttgggtatggatgagttgtctgaggacgataagcttgtcgtaaaccgtgccagaaagattcagagatttttatcccagccgttctctgttgcaacacagttcaccggtctggaaggaaaatacgttccgatcacggagacggttcgcggattcaaggagattctggaaggaaagcatgatgacattccggagagttacttcttaaatgcaggaaccattgatgaagtgcgcgaaaagtataacaacgcacagtagcggaaatgaggataagctatggcagacgagaacaaagtatttgacgtggagatcattacgccggatcgtgtctttttcacgggaacggcgacgatgatcgaatttaatacggctgccggagagcttggagtgtatgcgcggcatattcctctcacaacggttcttgcgccgggggttgtaacgatccacaagcagggcgaggaggatatcattgctgcggttcattccgggtttgcagagatcctgccggaaaaggtaacacttcttgcagagattgctgagtggccgaacgagatcgacaaggcgagagcggaggcggcaaaagcacgcgctgaggagcgtcttgccaatcggacagaggcgattgatgtcaagcgtgccgagtttgcgctgcgcaaggcgctggtgcgtatcgatattgccagataataaaaacggaaagtcagggaaaccggactttccgttttttgtgtgtatttgctcttggaaaagatatcggtcctggtatatacttagggtggaaacggtaaaaaccatgcaggcaccatgaatggagaggcatatgaatttttactttacacgccatggcgagacggaatggaatgtaaaaaagaagatacagggaacgacggacattccgctggatgagaagggaatacagcaggcgaagcggctcgcagagacactcttagagaagcagcgaaacggggagcttcatctggacagagtctacacgtcgccgcagcttcgggcggcagagacagcccgtttttccgcggaggcgctgggcatcgactgcatccggctctgggatctgcgagagatggatctgggagactgggaaggcaggaactgggatgagataagggagacggaagcagagcggcatcacatctgggatacccacaggaggttctgccatacgccgggaggagagtgctataacgaggtgttgcggcgtacgctggctgcgctggaacagactctggcgcacgagaaggacgacgtgcttgtcgtgacgcacagtgcggtgctgatggcgctgcggtgttatctggcgaaccgtccgtttgatgtgatgcgcgaataccggacgcgcaacacggaacttgtgcgggtgacggaggaggagatccgggaggcgatccgccgctatgagagagcaatatgagatactaattttgtgaggaaggatgatttcgtgaagaagtcagccttctttttatttgtgtgttttatacaaatttcgatgacgatttttgtgaacgattttgacggaaaatgattgactgtgactggaaacggaaatataatgcaactatagagatgaacgattttgaacgaatatgacggaaaacggagaataaattatgctgacagaggaaagatttgcaaagattttgtccatactggaacgtatggggagtgtgacggttcagcagctgatgacggaacttgacgcttctgaatccactgtgcgaagagacctgaatacgctggatgcaaacggccagcttgtcaaggtacacggcggagcgattttaaagaatacggtctacagtaccatcgatgatgaagtggttcaccgcaaggagcagaaccgggaggcaaaggataagatcgcacgctatgcggcgggactgattactgccgaagattttgtttatatcgatgcaggtacgacaacggaacggatgattgattacattgcaaaccgtcaggcggtgtttgtgacgaacgccatcggccatgcgaaaaagctggcggagcatggatgcaaggtctatatcctgggcggtgagttcaaggcggtgacagaggctatcgtcggtgaggaagccgtttttacactggataaatacaattttacgaaaggcttctggggagccaatggtgtcagcctgcagaggggattttccacaccggagttaaaagaggcgatggtaaaacggaaatccatggagaattgcagagactgttacattctggcggatgagagcaagttttcccagatatcgagcgtgacgttcgcaccgtttgagaaagcgactgtgattacgacagagttaaaacaggaaatatacaaggattgttccaatatcattaaagtcgagtgagaggagatcttgggtaatgatttatacgttaacatttaatccatctttagattacattgtgactgttccgaagtttacctgcggggtggttaaccgcaccacggaagagattattttccccggtggaaaaggaatcaacgtatccatggtgttgaagaaccttggctttgagaatacagcacttggcttttatgcgggatttaccggcatggagctgaagcggctggtggctgataagggaattcatgctgaatttatcccggtagataagggaatgacgcggatcaatgtcaagctccggtcagagcaggagagcgagattaacggacaggggccggcgatcgctgcttctgatattgataaattatatgaaaagctggatgcactgaaggatggcgacatacttgtcatggcgggaagtattccggatgtgatgccgcagacgatgtacatggatatcatgaagcatctgcagggcaggaatttaaaaattgtggtggatgccacgagagatcttctggtaaatgtacttccgttccacccgtttttaattaaaccgaacaatcacgaactgggagagatttttggcgtggagatctgcgagaaagaggatgttgtgacttacgcgaagaaactgcaggagaggggggccagaaacgtgcttatttcgatggcaggagacggagcggtacttgttgccgaggacggatcggtgtatcaggcagaggcaccggagggaaagctgatcaattctgtcggagccggcgattccatggtggcaggctttcttgcaggatatttggagcatggaacctatgacaaggcatttcagatgggggtatgtacaggaagtgcatccgctttttctgaagagcttgcaacaaaggcagaggtacttgatctgctggagaagaaccaaaacttgttttaattttgcggcaaatgagaattataaaatgtgcgcagattaaatagaaaccatttaacattatggaggaggaagaatcatgagaatcagggaattgttagcagtagagagcattgacctgaatgcaaaagctgcaagcaaaaaagaagccctcgatcacgcagtggatctgatggcgagaagtggtaagattggcgacgtcgagacttatcgaaaaggggtatacgcaagagaggaagagggcacaaccggtattggtgaagggattgcgattcctcactgcaaatcagatgttgtaaaggcaccgggacttgcggcaatgcgtgttgcaggcggtgtggatttccagtcgctggacggtgagaaggcagacctgatctttttgatcgctgcgccgaacaccaaagacaatgtgcatctggacgtattaagcaaactttctgtactgctgatggatgagaagttcacaaatgatcttcggaatgcaaagagcgtggaagagtttttacatgtcattgatgtggctgagagtgcaaaggatgtggaagaagccaaagaggcaccggcaaagacagagacaaagggcggcaggctgatccttgcagtaacaggatgcccgaccggtatcgcgcatacgtatatggcagcagagagccttgagaagaaagcagcagagttaggataccgcatcaaggttgagaccagaggttccggcggcgccaagaatgtgctgaccagagcggagattgccgaggcggattgcattatcgtggctgccgatacacaggttccgatggagcgttttgatggcaaacctgtcattgagtgcaaggttgcagacggtatcagcaaggctgaggaactgattaagagagcaatcaatggagatgcggctacataccacgcatccaataaagaagcggcaaatagaaacgataatgagaaggacagcgtcggacatcagatttataagcatctgatgaacggtgtatcccatatgctcccattcgttgtcggcggtggtatcctgatcgcactggcattcctgatcgatggattttccgtagatctgaattctcttccgatggatcagagaagtaacttcggtacgattacaccagtggcagcaatgtttaagtcaataggtggcgcggcattcggatttatgcttccgattcttgccgggtttatcgcaatgagtattgcagaccgacctggtcttgctgttggttttgtcggcggagcgatcgcggcaaacggaacttccggtttcctcggagctctggtagccggtttcctggcaggctatgtagtgcttctgctcaagaagatctgctcaaagatgccggaaagcctggaaggcatgaagccgatgctgatctatccggtgcttggtatttttattacaggtgtgattatgacttacgtggttgagccgccaatcggagcattaaacactctgatcaacaacggactcaatggattaaacggcgcaagtgcaattctgctgggtgcactgctcggcggtatgatgtctgtggatatgggcggtccagtcaacaaggcagcttatgtattcggtacagcatccatcgcagccggaaactataacatcatggcagcagttatggtcggcggtatggttccgccaatcgcaatcgctattgcaacattagtattcaagaacaagttcaccgcagaggagagaaaggcaggaccgacaaactttataatgggactttcctttatcacagagggtgctatcccgtttgcagcttctgacccgttacatgtacttccatcctgtgtggtaggatcggcagtcgcaggagcactttccatggcatttaactgtactctgatggcaccgcacggcggaatcttcgtattcccgaccgtcggtaatccattcatgtatctggtggcactggcgatcggatctgtggtatctgcggtactgttaggcgttctgaagaagaacgtggcataaataaggtttcttcttaatattatttgatgatatacccatatacaaaaatccccggggcggcatgcaatagcgtgccgccccggtggtttttgtatatataaatatagacaggaaagagcggttgtgctaaattaaaagaaaaccacgcaatgaggacttggcagaaggggatgctggtatggaaacaagtgagacagtaaaagaaatacgcagccggacagggttaaacagaaaagagttttgtcaaaaatttggtattccgctcaggacgatggaggagtgggagacaggtagaaggatcccgccagaatatattccaaggatgctggcatactatacgagaagtatagatacagacaatgcgaggaatgagataagaaatcactatgacattgtggaagatgcggaaggaaataaagttgtcattatcaatgatttacgatttaaaagcagaaggaatattgactggaatacagtggaacagtgtttaaaggaatatgttggaagctgcgtgcagattttagaaacatccgatgagatttatatcgggaaagattttccggatgaatatacgcattccaaagatacgaaaagcctaaaaggtgcaaatcggcatgcaaatgcatctcagattgtagaaccaatgataaaaattgccgccggtaaaacatttgcgcctaattacgaggaaaaacatgtggcagatgcaaaatatggatggtatcgttatgatacacgttttgcaatacctgtatacaacgatgagggaaatttgtgcagatataatatctttggcgcaaggattttaatacgccatgatgaagatggaaaaatgtatttatacgatattctgagaataaaaaaagaaacgagcgagccgcttgagcaatagctgtacggtcgaaaaactcatttcttagttgtattataacaggataactataaaatgcaagaaaaaattaaggacagagcagggaaagaataacacaggaggattgcgatgagtcagtatttattgttaaaacagggaacgatccataatgccgtcgacgaggaggcatttgtggcggatattttgattgaggacggaaaaataaaaaagattgcgcctgtgctggagggcaaagtcatcaatgaagcggctgtcattgatgcgatggggatcgatgtctatcccgggtttgtggatgcacactgccatctggggctcgacggttatgcggtcggttttgcggggcaggacttcaatgagcttggcgatccgatgacaccgcagctctcggcgatagatgcgatcaacccgcaggatgagactttccgcatggcaagggagggaggcgttacctgcgtgtcgacaggaccgggaagctccaatgtgatcggaggaaccttctgcatcatcaaaacgtatggaaaccgcgtggacgacatgattgtccgggaaaaatcagccatgaaaattgcattcggagagaatccgaagaactgttataaggaaaaaggcgtctattcgcgcatgtctgtggcggcaaaactgcgggaagtgctgcagaagacgatcatctacgataaaaagctgcgggaggcaggctgtgagacaagctggaatgagatcaaccgcggcagcggggaggggcaggtggacatcagcaaaatgccagcctacgatgcaaaactggaagcaatgctgccggtcatccgcggggagataccgctgaaagcgcatgcacaccgggcggacgatatctgcacggcaatccgcattgcaaaggagttccatctggggttaaggctcgatcacgtgacggacggcgcgctgatcgcaaaggaattgggtgcggagcattttccggtggcggtcggtccgtccttcggtcatgcgacgaagtacgagttgaagaacaagggatttgagacgcctgcaattctggcggatgccggctgcgaggtgtcgatcatcaccgattcgccggtcatcgaggagcgctatctgccgctctgcgcagggcgggcaatctacaacggcatgcgtgagtttgatgcgctgcgggcaattaccattcaggcggcaaggcatatcggcgccgaagatcgtgtcggaagcattgaagaagggaaggatgcagattttgttttgctaaaaggcaccccgttttcggttgacgcgcggatattatataccatcataaacggagagattgtctatcagtccggggagtaatgtgacggttatctgaatgttatgtgaagtctgttattttttctgcggcagaaccgatagctattttgaggaaaatgcaaaggatggcacaatttcgggaaggaaccacctcagaaaggaattggttatgaaggtcgagagttcaagttacgaggcatatctggaagcactggaagagtggaagcagaagatgcaggagagccaggccgcacagcagaaggaagagaacagcgctacggacagttatgtgccgggcatcagccagatggacatggacattccgatgccgagcagcacttacaatgcacaggggatgatgagcggagaacgcccgccaatgccgccgatgccgccgcaggagacggaggagacagacgagacgacggagagcacacaggtcacgggaacgacagagacgcagggaaccgcagcgacaggaacagaggcattgcttgaggagttgtcagagacattccgcgcaaatccggacagcatcctgatgaagctggatgaattgggattatcgctggaggatctgggtgacgaggataatcttgcattacttgccaccgcaatgaacgaaggagcggcaaatatgggcttgccaaccattgaagatctggattctgtggtaagcaccctgcatgagaagttgtccgcgaactggagcagctactttgaagtggaggaagcatagatctcttttggggataagtaatattataagaaacacaccgtgtggatttcagatggaaatgcagatggaatattcgttggagaaaaatgtgagcatttcttccgatcgaatggttgcatcagattccgtgtcttttccacgtttggacaatccgacgggtgcatgtccgacacaccggagacaatgggcggactttctggtgtccctaatggcacctcttcacagacaatataaaaccgcgcgaaccgaactcgccggcatctgctattgaaaatagggcagatgccgactcagatagcggcttcgcgcggttatgttttgttcagaggtgccataagggacacacacaaaagtcctacaaattgtcttccggagtgcggacatgacccgtggagtgctccaaacttggaaagacacggatcatcgaagatgcaaccattcggttggttagaaatgccatattttttgaaccgaatattccatctgtatttccacatgaaatccccaagtgtgtttcttataatattacttatcaaggcaaagcatggaagggaactttttgtttgcataaatgtggcgcgtggattatagtattcgtataaatatagaagaaatgaagcgggaggcagtgcggcatggagtcgacattgagacgtacctgggcggagattgatctggatgccctggcacacaattatcataaattaagagagagaatcggtgcagatgtaaagtttctgggggttgtgaaggcggatgcctacggacacggttctgtacaggtatcgcatctgctgcaggagcttggtgcggattatctggcggtcagcagtattgatgaggcggtcgagttgcgtttaaatgacgttacgatgccgattttaattctcggacacacaccgaaggagcaggtatcaagactgatcaaatatcacattacacaggcggtcagctgtgaggcgaaagcgcttgagtacagcgaagaggcggtcaagtgcggcggcatcttaaagatccacatcaaggtggataccggaatgtcgcgtctgggatatctgtgcgacggagatcattttgagacgggcgtggcgggaatctgtcacggctgctcgctgccaggactggatgcggagggtatctttacgcatttcgcggtatcggacgagcctggcgaggactgcaaaaaatacacggagcatcagttcgacctgtttatgcgcgtgattgaggaagtcgaaaagcgcctgggaagaaagttcgcgctccgtcactgcgcgaacaccggcgcggttgcaagatatccggagacctttcttgatatggtgcgcccgggactgcttctgtacggctacggggagtttgcggacgagctggggcttttgccggtcatgacattaaagacgacggtcagcaccatcaagatctatccggcagggacggcgatcagctacggcggcatttttaagacagagcataccacgcggatcggcgtggttccctacggctatgccgatggctttttccgctgtctttccaaccgctgcgcgctgatgacaaaagagggaccggctccgcagcgcgggaagatctgcatggacatgtgtatgatcgatctgacaggaaaaatgggtgtggatgttggaagcgaggtcgaggtgttcggaaaacagaactccatcaatgatcttgcggcacttgccgggacgattccttacgagcttacctgcgcggtgagcaaacgtgtgccgcgtatctatatcagaaatggcaaagttgtggaaaaggaacttctgttaagaggatagaggaggcggacggaccggagatgtcagaaaatggcatttccggtttttttataagcgaaaagatgccgatttataagccttatgtataggttatgtaaaatctagtaaaaatttagtaaaagtttactaacgctattgaaattaaaaaaaacgtgaaatataatgcagaagaaaggcgtgattatatggcaacaatcaaagaaattgcagagttagcaaaggtatcaccggcgactgtatcgagggtactgaatcaggatgagacattgaacgtcacagcagaagtcaggagccagattttaaagattgcccacgaattaaactatattccgcctaagatgcgtcatgcgcagaataagacccatgttacgatcggtgtggcagactggcatctggtaagaggggacaggcacgacatacgactggcatcgctggaccatatcgcagcgacgatgccgcagaaggtggacgtcagctttttgcggatcacctgcagggaagatgcagatgtcgacgggattctcgcatttggatctttttcggaggaagagataaattttctgcgaaaacagagtgatgcgatcctgtttgtcaattcggatcagaaagattatgagtttgaccagattatcatggactatgagcagggcttaaaggatatggtacactatcttctggatgtcaaggaataccggagtatcggttatatcggcggtatctatgagaaggatggtgtacggatcggtacccaccgcttaatgggactgacggagatccttgcgcagagagggtgctataaggagcactatttctgtgtgggtgaaatcagcagagagagcggctaccgtctgaccagagaacttctggagacagatgatgtaccggaagttctggtgcttggaaatgatgaggtggcagaaggcgccctggaagcggtaaaagaattaaaataccggattccgaaggatgttgcggttgtcatttaccgtgatattgagacgctgcagacgaaatatccgacatataccagtcttcggatgctgccggatattgtatggtcaacagcaatcaagcttttgctggaacgaatcatcgacaagcgcgtggacagtatgaaggtttacctgccgacaaaattggaactgggcgacagtgcatgaataattgtttcactgcagagaggagaaatttgcaattatgaagagattgacagctactttactggcagcagcaatgtgcatgggtacatttgcaggctgtggaagtaacacagaagagacaacagataacagcaatgcaggtgcagcagcaggcgagacagcagctgctactacggagagccagacagcttccgctgagaatgtgcatctggatgcgttaaacgtatattttgtaccgtccagagatccggaagagatcgtaactgcaacagagccgttgagtgatctgttaaagaacgagcttgcgggactgggctatgatgtagacagtgtaaacatttccgtaggtacgacatacgaggcagtaggcgaggcactttccgccggaacagcggatgttggatttattccgggcggtacttacgtgctctatgatgacggatgtgatgtgatcctgaccgcaaccagagatggtctgaacaaggactccgacaatccggcggactggaatgacggacagccgacagaggcatctgacaagcaggcagtatcttaccgtgctctgttcatcgcaggtccttctgagaaaggacaggagcttgcagacaaggtaaattccggagaggagcttacctgggatgatctggatagcgcaaactggagcgtgatgtcttcttcttcaccggcaggctacatttacccggcattatggatgcaggatcgttacggcaagggcatcacagatctttccaatgcagtacagtctgattcctatgcaagtgcattcgcaagacttgcatccggacaggtagatgtattggtaacctacgcagacgcaagacgtgactacgaggaaaactggaccagcgagtatggacgctctgcttccatctgggaggagacgaacgtcatcggtgtgacagatccgatctacaacgataccgtctgtgtgagcaagacctctccgtacatggatgagaacttaaagacagccattcagacagcactgatcaacatcggcaataccgaagagggcaaggcggttatcgcaatctacagccacaacggatatgagccggcacagtcttctgactatgataaggaaagagaagcacagaagctgattcaggaactgaacgcagccaactaatcagaaacgggcagacaaagggtgcagtgtcagcggagtgatcttggaaagagacatcactccgctgtgctgcacattttttaaggcaatgtggaaggagcatttatgatagagttttcaaacgtatccaaggtatatcccaacggcgtggttggactcgacgatgtcaatcttacgattgagcagggcgagtttgtgggaatcatcggtctttcgggagcaggaaaatcgacactgcttcgcacgatcaaccgtatgcatgacattacttccggtacgcttacagtggacggacaggaggttaagaacctcaaaggaaaacaactgcggaaattccgccgcaatatcggaatgatttttcaatcctttaatcttgtgacacgcaccacggtcatccgcaacgtattgatggcaaaagtgcctgagatgccgttctggcgtgtattactcggtatatttaaaaaagaagacaagttgaacgctttggaggcactcgacaaagtgggcattttagataaggcatatatccgtgcggaccagctttcaggcggacagcagcagcgcgtggcgctcgcccgcacacttgcacagaatccgaaaatcatcctcgcggatgagccggtagcggcgctcgatccggtaacagcaaagcaggtaatgagcgattttaagaagatcaatcaggaaatgaacattaccattttgatcaatatccaccacgtagaactggcgcttgcctatgcggaccggatcatcggtatccgcgccggaaagatcgtctatgacggaccttccgcggatgtgacagaggatgtgttaaacatgatctatgccggaaagataccggatgaggtggaggaagcctgatgggaatatatgataaaattttcaagccgaagaaactggtgttatccgacggaaaagtagtggaggaaaaacgcacgcgcacaccgcttgtacttcttctgcttctgattgcgaccgtcatttccgtccggattaccggtttttcgctcaatacgattctcacacgcggaaatcagttttttgtcatattaggacagatgtttccgccaaagacgggatatttaagcagtatctggggaccgcttttagatacgatcaagatgtcgctgctcggctccttcatcggtggggttctggcaattccatttgccatcctggcatccagcaatctggtcaaaaataaggtcgttctgggcgtggtgcgtatcttcttaagtatcgtgcgtacgattccgaccctggtggcagcactgattgcgacttatatctggggacttggaacaatggcaggaactgtggcaattgccgtctttacatttgcttatgtcggcaagcagctttacgagctgattgagacggttgacatgggagcttacgaagcgatggaagcgatgggagctggcagggcacaggcatttctggcagcgatccagccgcaggtgcttccggcatatctttccgtctgcctgttctgttttgagggaaatgtccgctatgcggcaatcctgggatatgtaggtgccggaggactcggtctgatcttaaacgagaagatcggttggagagagtacgacagcgtgggcatgatcctcgtggtattattcggaacggtgctcgtgatcgaggcactcagccattatattcgtaagaagcttacctaggaggggacaaggcagaatgaaaaaagaaatagataaaatgtatgagcagaagccgaagacgtggtatgcgaagattcttgtggcactcatcgttgcagcacttctggcatggtcgatgtccacggtgcaaagcggaacaacaggcggcgatgggcttacggtagcgggaaagattatcagcggcatttttcatccggacacagcgctcttatttaattttacaacctccggcgtggcgtatctgctgttggagacaatgtgtatcgcatttctgggtacgattgtgggagcagtgctctcgatcccgctgtcttttctggctgcagccaaccttgttccgaagccgattgcactgattttccgtgtgtttattatggcgatccgcacaataccggcatttgtatatggactgatgttcatccgtgtgacgggaccgggaccatttgcgggacttctgacgatgtccctgtgctcgatcggtatgatcagcaagatgtttattgagagtatcgaagaccttgacaccaagatactggaatcgcttgatgcagcgggatgcacgatgttccagaagatccgttatggcattctgtcacagttattcccggactttatgtcaacgttaatctatcgttttgacatgaatcttcgtgatgcgactgtgcttggtctggtaggtgccggcggtattggtgcgccgcttatttttgcaatgagcgcgtacaaatggaatcaggtgggtgcaatccttgcaggactgatcgtgctgattctgattgtggaagtaatctccacaaagatccgtgtgaagctgacgcggggataactataatacgactgagggataagatggaacaaacgttaaagatatattttacctcggatgttcacgggtatttttacccaacgacttacggggatttgaaacgaaaagatctggggctgttctcgtttgcccgggatttcaaaaaagatgagaatacactggtaattgatggcggagatatattgcagggctccgcctttgcctactattgcaggcagaagtcaggatcgccgcaggccattgtggatatcatgaacgactgcggctacgattattatacgctcggcaaccatgattttaattatgggatggactatcagaacgcttacatagaggctcatcacggcgcgtgtgtctgccagaatgttgtagatgaggcgggaagagcatgccatccgtatgtgatccacacgcttggaaacggactccgggtcgggattgtcggtattgtgacagactatgtgaatgtgtgggagcggaaggaaaatctcgcgggaatttgcattacagacccatttgaggcggcaaaagaggcgcttttgcatctgaaaaaagaggtggacattacgctttgcatctaccacggcggatttgagtgtgatttaaagaccggagagcgcctgcagaagacgacggagaatgtcggataccgcatctgtaaggaactggattttgacattctgctgaccgggcaccagcatatgtccgtcgacgggcagtatgtgcacggaacttatgtggtacagccgcttgagaatgccaaagagtatcactatctggaagcggagcggacaaaagacggacttgttgtccgctccgagaagcgtgtcgccgacggagcaaatgctgtcggtgcattatgcgaaaagtatgccgcagaggaagagcgggtacagagctggctggatcagccgatcgggcatttaagccgggcgcttcttcccggagaaaaagcggaaatggcgctgcacggttcgccgattgccgattttttaaaccggatacagttacatttttccggcgcacagctgtcagcggtcggtcttgccaatgagatcgccggatttcgcagcgaggtgagtgtccgcgacattatagcaacctatccgtatccgaatacgctcatcgtatgcaggatcagtggaaaacagttaaagcaggtgatggagcggagcgcggagtattttgccgtcgccacggatggaacggtgcaggttgcggaaagcttccttgtgccgaaggtggagcactataactatgactactatatgggggcagcatatgagattgacccggctgcaccggtcggaaacaggattaaaaatctgacttaccagggaaagacggtaacggagacagattcttttacgctgtgccttaacaattaccgttacagcggagcgggcggatatgaagtatatacggaatgtgaacttgtccgtgaaatcaatacggagatggtggaactcattctggaatatttcaaagagaatccttatgtggaagtgtaattgtaggtattgcacaaaaataaaaagataaattgaacacaagtgccgaaagtgtcgaaaaggatggaattgttgcaataagcatagccctcttttgggtgataagtaatactatgagaaatagatacttaaaagttccagataaacatgcggcggcaaattctgaccgcaaaatccggtatttctaaccatgccgcagccggcatccgtgatgatccgtgtctttccaagtttgaaacactctacggactgtgtccgcaagccagcagacaattttaggacttttgtgtgtgtcccttatggcacctctgaacaaaacataaccgcgcgaagccgctgtctgagtcggcatctgccctattttcaatagcagatgccggcgagttcggttcgcgcggttttatattgtctgtgaagagatgccattagggacaccagaaagtccgctcattgtctgcggcttgtcggacacactccgtgagtgtccaaacgtggccaagacacggaatgggatgccagccacggcatggaagaaatactcgaattttgcttcaaagaatttgccgccgtctgtttattctggaacttttttgttctctggtcttctaataatattacttatcactccaaagcacgatatgctcattgcggcagttccatcctttaatcgtttttaataaaaagactcttgtagaataaccgcattctgtgttaaaatatgttcaacaaaagcatatttcttacgagttcagggtgttcgcaccgtctattttcttatcacatttcagaggtctatgctttttatccaatcaacgaacgagaaaagcagggacgctggggtggcggttcctgcaaaaagggggaactgcatatggaagagaagaggccgaaggcgaggcgggagtacaaggatacggtattccgcatgctcttttcagacgagaagaatctgctgtcgctttacaatgccgtgaccggaaggtcatatgaggatgccaaggagcttgagattgtcacgttggacaatgcagtctacatggggatgaagaacgatctggcatttttactggatctgcacatctctctgtacgagcatcagtcgacgaagaacccgaacatgccactgcgggatctgttctatatttctttggaatatcagaagtatgtgagtgacaagtcgctgtattcgtccgcattgctgaagattcctgctcccgtgtttatcgtgttttacaatggcgcggaggacatggaggagcgcacggagcttcgactgtcacaggcatatgaacactttgagggagagccgaatctggaattgaaggttagggtgcttaacatcaatgccggacataatgcagagcttatggagcagtgcaggatgctgaaggaatatgcacagtatgtggcaagagtccgcgggtacaccgcttctatgaagctggaagaggcggtgcggcgggcgattaaggagtgtattgcggaagggatcttagcggatttccttcggaagaatcgtgcggaggtggaaatggtgagtattctggaatacgataaggaatatgaagagaagaagcttcgcaaagcggagtacgaagcgggggagcaggaaggtctgaaccggggtctggcacaggggattgtggagaccggatgtgcctacggcgtatcgaagaaggagattcttgagcggctgcaggagaggctgaacatatcctgccagacggcacaggagtattttgcaaggtactccggcaagaagatctcttagtccgaggctgccagagacagggtgctgacagataggtgcacaagtacacaggtatgatgctgtatagacggacggagacagaccgctacagacatctgagcccggcatgctgacagacacatcacagcatgccgggcttctttttgcgttaccgcgttacattgcgtcagacctcatttcgtggtagaataaacctatcttaagagctgatcgggatctaaggggcccgatgagtataaatggggagtatatttcacaattaaggagggtttttgcatgaaaaacaaaagaagaattctggcggggctgcttgcggcagttctgaccgtgccgctgtttgccggcggcgcacagataactgcggctgcggaggcggccgggaagacactggatgtggtgttcacgcacgacacccactcccatctgaacagtttttccacggtgattgacggagaatccacagaggtgggcggatttgcaaggatcaagacagtgattgatgagcagaaagcggagaatccggacacgctcgttgtcgatggcggtgatttttccatgggtacgctggtgcagaccgtctatgaggatgaggcggcagagcttcggatgctgggcgcaatcggctgtgaagtgacgacgtttggtaaccatgagtttgattaccgttccagcggactggcacagatgctgaagagtgcagccgaaagcggcgacgcactgccggagcttgtggtgtgtaatgtagactgggatgcgatggaggctgcggggttaaacgacggacagcagcagattttaagcggatttgaggagtacggcgtgaaggattatgtcgtgctgcaaaagggagatgtcaatgttgctgtgacaggtgtgttcggtgtggacgcacttgcctgcgcgccgacctgtgaactgttattccgcgatccggtggaagcagtcaaggagacggtggcagagatcaaggcaaatgaggatgtggacatgatcgtctgcgtatcacacagcggtacgtgggaggatgagagcaaatccgaggatgagattcttgccaggagtgtgccggatcttgacctgattatcagcggtcatacccacacagagctcgcggagccgatcgtgcacggcgacacgtatattgtatccacgggagagtacggcaagaagatcggagaactttccatgacccagaagagcgatggcagatgggagatagcggattataaactggttccgattctttcgaccatcactgcagacggagcgacccaggagaagattgatggcttcatggaagcggtggatactggttatcttgcagatttcgggtacaccaaggatgaggtgcttgcaaccaataatgtgcagttttccacgttgcatgatcttgagtatgagcacacggaacacaatctgggagatttgatgtcggacgcctatgtgtatgccgtggagaactccgatgattttgacggtgtgccggtggatgttgccgtggttccgagcggtacggtgcgcgatacctacacggccggggacattacggtggagcaggtgtttaattctttttcccttggcatcggtccggacggcgtgccgggatacccgctgatcagtgtctatctgacagggaaggaacttcgcacagccgcggagattgacgcgtccgtctccgattacatgacgacagccagactttatatgagcggacttcattttacatacaatccgaaccgcatgattttaaacagggtgacggatatttatctgaccgatgagaacggaagccgcgtggggcttgaggacgataagctgtaccgcgttgtggcagatctctacagcggacagatgttaagcgcggtgacggatatgtcgcacggactgttgtcgcttgtgccaaagtatgcggacggaacgccgatcgaggattttgaggacgtcatcgtgatggaggggaaccgcgagttaaaagcgtgggattcgattgccagatatatgcagtcctttgaggatacggacggcgacggtattgccaatgtgccgtcttactacagccagatgcacgaccgcaaggtggtggatgagagccgctcgctcggcgatcttgtaaagagcccgaataaatatgcggctatgattgtcgccgtgattctgattgtgataattctggttgtattactgattgtgttagtggtaaaattgataaaacgcatacggagacggaaagcggatacaatacataaaagataattgaaatacaggagaccattatgagtgcgcaggataagacagagcaggtgttgcgggaaatgcatatcatgtatgccaacagcgagatgtatgataaagcgacaaaccgggttatcatagacaaaaagaaggcgttaaatctcctgcagcgtctgaatgtctgcatctacgaactcatggaggaacatgagcttacccagcagagccgcgatgcagcagaacggcagttccgcaggaaaacggacggtattgtcgaggatgcgaaccgcatggcggaggatgtgtatgccggatcggtcatgtatacggatgaggcacttcgccgcgtacaggatattatgcaggatgcgatggactctgtccgggagatctgcgataagatgaatgatgcgctcgcgcaggaaaagtcaaatgtgcgcagggatcagtcggagttaaagagccaccttgaggatttaagggatacgaacaaatacatgaatctgatcgagcagcgcaacaaggagattgcaaaggaacgcgcgaagcgcgggcaggagaaagaagaggcgacttccgtctatgcatccgtaaagccggagatcaagataaacgaagagtattttgagaagaatggaattccgttagagacagaggaaccggaggaagagccggagaagaacaccggtgagaccggggcggagataaaagtaaatctcgatgcggaatacttcaaatggaaagaagacgctgacggcggcaaagaggagaagaaaccggagcgccattctttctttggcaagcggtcgaagtaatagaattgaagagagagtggatatccaattggtggaagatccgctctctttttttactctaaccggtaggcgcgcggcgacatgccatagtgcttccggaacgcatccccgaaataattgccgtcagaaaaaccgcagatccaggcaatttcagtgatcgaagtgtccgtcgtgcacagaaggtgcgcggcgttctgaaggcggatgtgcgttaagtattccttaaatccgaatccggttgtctcccggaattttttggaaaaataagtgggattcatatgtgcgaccgccgcggcggctgccagtgagaccggttcctcgtaatgttcgtagatgtagcgcgcgctttcctggatggcggtgctggtctcgtccagaaattgcggagtctggtggacatcctggcagcgcgcgatctcaaccagaagctctgaaaaaagacttttggtcatgagcggtgcataaggatcgctgctttcggattcaaggcgcaggcgcgtcatcaggcgttctaactgcggacggctggaagacggaatggtgagtctgctgcgggaaaaaagcccgacgcaaagatccgggccgctggcggcagacacccggtgtaagtaatcttccgaaaaaaagatgttgatgcgctcggcaggacgcttggtttcatagagaacgcggtgcagcacagagggaggaatcataatcagatcccctggaaagagccggtaaatgctgtggctgataaaacagcggcactgaccggacagcaggtaataaaattcgtagtacgggtgataatgggattctcccatatcaaaatgcgaatcgcgctgtacctgcgtaattttaaaatcggcaatgcggtcgtgacagctggaggaagcgaaatcgttcatgggtataactcctgttcctggttccgtgaaggtttctgcggaatggtgattctggatttttgcctgcaatgacaaaaaatcagtagtataaagcaaaataacggaaaaaattcgtataaataaatatatttttgttataccatgggagaacagaaaagtaaagaaacgcagatacaaaaagaatggagaagaacatgcaggcagatctttcaaaaaaggacgaacaatttcgcgagttttccctgaacggacccatgtggcgggtggtattgtatgtgggatttccactggcgctctatgagagcctgaaccagctttttaagatactcgataccatgatggcgtcacatatcggcgcatccgcggtgtccgcggtcgcgtatttgtcccagatcaacatgatgatctcggcggtgggaaccgggcttgcggtgggcgccagcatcaaggtgagccaggcatatggggccggcgatttcatgctggtaaaaaagcgtgtcagcacaatgtttgccatgtgcggggcgctcggtatcgcaatactgcttgtcctggtgccgttcacgccggagttcctgcgcctgatgaatacaccggaagaatttattgcggacgggagcacgtatttcaggctggagttgttcggaatggtcatcacgtttttcaataacgtctacatcgccattgagcgtgccagaggaaattccaaacggattctgattctcaatacggcggtcatcgtagtgaaactggggctgacggcatggtttgtctacgggctggacggaggcatcaatatgatctcctgtgcgacgatcatctcacagagctttcttcttctcgctgcgtgcatcaatatgaaccagaagggaaatgcgtttggcttctcattgcgtgccatctccataaaaaaggaggtcatctgcccgatgctcacgctgtcgtttccggtcatcgtggagcggattgcgtttgcggttggaaaggtgattgtcaattcgatgagtaccgtctacggttcctggacggtgggagcgcttggaatctccaacaatatcggcggaatcacgacaaacccgcagaacggatttcaggagggaggctcctccattatcagtcagaatctgggggctggcagaccgaagcgcgcgcttttggcgttccgctgggtgctttacattgacatgctcatcggactggtcatcatgacggcgtcgctgttatgcttaaaccagctggcaggtctctttgccggggacaatgcagagtttgccgagatgatcaaacagatttaccggtttgaggcggtcggagcaatcccgctcggcgtcaacgcggcggtaatggcgctgctctatggatttggaaagacgcgtgtgacgctggtcatgaacttctgccgtgtctttctgttccgagtgccggtactttgggcgttgcagcagttcacggatctcggaaacgtcagcgccggcattgtcatggcggtgagcaatgtggcgagcggcgtgcttgcagcggtggtgggcgtcatcgagatacgcagaatctgtaacacatacgatgtgcggtattttggcggagaacggaaaaattaagaaataaaaactacacctatagattgcaaatatttcaactctatgttaaaatgtctaaaacagtatcaattcgatagaataaaggacaggacatgagtattaaagatagaattctgaaaaggcgggaaagatttgcatacgaacgcgcacactgggtggatgcggatcccgaagagagctggttttatcttatgacgaacatacagcgcaacaacctgtattcgctggtattgatcggaccggcaattttttgcatcttattttactattttacagggattacgcccaatattgcgctgtcttatctgatcattgacatgatcgtcatcttttccaagaggcattttgcaatccgaagaatccgggaggatcaggcgtatgcccggctcggtgaccgcacagaggttcttttgcagatggcgcgggaactaagtgaaaaagaccagatgaagagggaacagaatacagatcacacagataaaagggataagaataaaagacacaggagaagaggagggacagacaaaagagacaaaagaaagagtgacactacgaccgggtagcgtccgtgtgcttcatgacttcgacaagttcacgcagaatacggatctgcgcatcggtgaggtcttttacctcgatgatcgtagcgtaggaatcggtcgtggttcgtccgagaatatagtccgtggatgtgtgatagatatcagccagtgcgatcaggcgctccagactggggttacgctccgttttctcataagcgctgattaaggcaggcgttacaccgagacgatttgcgactgcactctgggacagatgattcttttcacgtaattcaattaaacggtctgccatattcttgtccataatcaacgcctcgctttcctgcttagtctagtgcatgtttcccatacttgcggttatgaagagatcaactgtaagttgaaaacgatactacttagaatatgcaggacatgaaaaaatacacccgctgaagataaagaatatcatagcaggtgtatttttatcattaaaggcgcagttgtcactgatatggcagaaagcccatttgaagcgggatcagaagccgtcgccctcgcggtaaccggttttgctggtgatcatttcactgttgtttttcactgtatcggaaggcgtgtaagccatatctgtatagaggaactgatgaagtgccgtgacattggacgataggtcgcagggaatcacgacatctcccactttgttatagcggtgggcggttttttcatatgggaacccgttggtctcgctgagcttgtaattaaaaatattggtggcgagtgcaagcagatccgcattggagaagctggtctgaatatcgctgaagagagtgttgattagtgcgttgagcgtcttcagatcggatttttgtgctttggcaatcatagctgaaagtaccgcacgctgacgttccgtgcgcttgtaatcatcaccgccgccgtaacggattcgtgcaaatgccgttgcctgcacgccgtttaaggtgtaagttccgccggaagacgggcaggaagcggtatttccggtaaggcggtttaattcctgaatatagccgagcatcaggctggcttcgtcatcggtgatcgtcatttccacgccgcccagcagatccacacattcgacaattgcactgaaatccaccgtcacataatctgtgattgcaagatcgagattggtattgagcattgagagcgcctgctcgggtcctccttttgcgtaggcggcgttgcatttttcaaagactccgctgccggtgtccagataggtatcccggtagatggagaccagttggacctcgtgcgttttgttgttgatattggcgagcataatgacatcgctccgccctttggacagggaattgtttgtacggttgtccagaccgaagagagcaactgtgcgatagtctgacatggcatccattgtttcggaggacagatcttcattgatggcgacttgatccatgtcaagctttgttttctgtatttttgaaagttttacaactgcaaacaacaaaagagtcagcagaagaatcagaataatttctgcaatcagcaaaatgactctgcggcgtttcttcgtttttttctttttcatatcaaagatcctccagaataaaagcatggttgggttacctgcttatcttaaagcgggaatatgccgcccgcaataaagattctcttaattttgcgcgcagatttttaaaaataattaagaaatctcctctataacaatttgcgcgtgtctgttaaaatgaagaaaacaggcaatagaaaggctgatatgcagtgcgatatctgccacgttagaatggagagaagagaatgcagacaattctggtatgtgatgatgacaaagagatcgtggaagcgatcgacatatacttacagcaggaaggctatcaggtattaaaggcgtacgatggagaggaagcgcttgagatcttaaaagaaaaagaagtccatcttctgatcatcgacgtcatgatgccgcggctggacggcatccgggcaacgttaaagatccgggaggagagcagtatcccgatcattattctatctgcgaaaacggaagatgcggacaagattttaggacttaatatcggcgcggacgattatgtggaaaagccgttcaatcctctggaactggtggcacgtgtaaagtcgcagcttcgccgttatacgcagcttggcaatgcggcagagaacgacgcgtccgtatataccgtcggcggtctgtcgatcaacgatgatttaaaagaggtcacggtggacggggagacggttaagctgacgccgattgaatacaacattctgcttctccttgtgaagaatcaggggaaggtattttctatcaaccagatctatgagagcatctggaacgaggatgcgatcggtgcggacaatacggtggcggttcatatccgccatatccgcgagaagatcgagatcaacccgaaagagccgcgctacctcaaggtagtctggggcgtgggctataagattgacaagaactagaggagcgtctttatggagaaaagatcctacagttacggaatgaaaataacgggagtgctccttcattccttttttacaatcgttcttacagtgtccgtgttccttctggcatcgcttgtcagcaagaatattctggagcttaccgatattggaaccgatgatttccttagttccgggtattatctgaaatgcatggagcagaagtgcaatgatctgaacgattatctgctcctaacacagaaaggcgcgcttcggacagcggaggatgagaaacgctatctgcagtataccaatgaatttaagcaggagagtacaaatttctgctactggtataagatcaatggcgtgtggtatactaatcagccagataccagagaggggcagcagttcgatacgcagacggttctcatggaggcaaagaccatgggagattatctgctttacgatatggaagacaaggaatttggcacggatatccggggactggagaattattttttcagcaataacggcaatcagatctactggcccctggaagacgtggtgcttgtcatcggcgtggacacacagctttcggcaggggatgatctgcgggatgccaagatagaatatgaaaggcttcatccgtggatcaaagtgagcattgcaggggcaattatcagtctgctgggctggattctgacgcttgtgtacctgacactggcagcgggacacaaggagggggaggaaggcatcgccttaagctccattgaccgcatcaagaccgaacttatgattgctggctttgtgtttttatcggcggagctggttatgctgcttgcgagagcaagcagccgggaatgggaggttgcaggtctccttgtcgcatcagggaccatcagttttctcattgatacgctgtttcttatcttctatctgagtatggtgcgtcgcctgaaagcggaagtgatgtgggagaacagccttgtgtgctggcttggacgcgggattgagaagacgttccgggaaaggtctgtcacagttaagattttgatgatctttgcgattcatatgatcgtctgctttttcctggcggcgggagcgttttactacagaaatgtgccggcactcattgccctgctcttattcagcgccatggaggcatacattctgctccggaaagcggtggagcactatcagatcctgcagggagttgaggagattgcggacggtgatctctctgccaagattgacgttgaagaacttcacggtgaggaccggaagctggcggagacgatcaacaatatcggcgccggactgttgcatgccgtggacgacagcacgaaaaacgagcgcatgaaagcggatctgattaccaacgtctcccatgacatcaagacaccgctgacatcgattatcaattatgtcaaccttatacagcgcgaggatgtggacaacgagcgcgtgaaaaactacgtgaagatcctggacgaaaagtcccagcgcttaaagcagctcacagaagatctggtggaggcatccaaggtcagttccgggaatgtgaagcttgagatgcacaagatcgacattgtggaactggtgtgccagactggcggcgaattcaatgaaaagttcgaggacaaagaacttacgatagtgacaaagcttccgcgccaggcggtctacatctggtcagacggacggcacctctaccgcgtgatcgagaatctctataataatgtcgccaagtatgcacttcaaaagacgcgtgtctatgtggaagtgcaggcggacgaagaacgtgccgtcttttctattaagaatgtttcggcgcggtcactggcaagagagaacagcgaagtggaagatctgacggaacggtttatccggggggattcctccagaacgacggagggaagcggtctgggactttccatcgcgaagaatctcacgcttcttatgggaggaatgtttgatatttctgtggatggagacctgtttaaggcgaccatcgctcttccgctctatgtggagggacaggaagaaagggggcagtgatatggtaaaagcagtgatctttgatatggacggggtactcattgacacggaaaaatggctgaacaaatactggcgccaggcggcagcggaggcggggtatgatatgacggtggaggatggtcttgcgatccggagtctcgcggcaaagtatgcggcgccgtttctgcaggagcggtttggagcggatttcccgtactggacgatccgcgagcggcgcaaggaactgatgaaggcgcacatcgcggcgaacgggatcgataaaaagccgggtgtggatgaacttctggactatctgcgggcgcatcggattaagacggcggtggcaactgccacagatccggcgcgcacaaaggattatctcaccagaatcggcatctacgacaagtttgaccgtatagtgtgcgcaacgatggtggagaacggcaagcccaagccggatatttatctctatgcctgtgagcagatcggggaagcgcctgcggactgtattgcggtcgaagattcccccaacggcgtgcgctccgcaacggatgcgggaatccggacggtcatggtgccggatctggcggaaccggatgcggacacggcaaaacgcatcgcggcaaaagcgggtacactctttgatatcatactgatgtttgaagacggcgatttgtcatgataaagcgcgaaagtgcttgatttttacctgcaagaccgatataatttttgaaaggctatgataagggcaaggaggaaatcatgaagttatatgacagcggagtatatctggtaaacggaacggaactggttgcggatgacgcgcaggcagctgccgcaataaagagcaggacgggcagagaggtggcaaaagccgaggcggcgcagggaacgatcgcatacggcattttaaaggatcacaatgtatccggcaatatggacaagctgcaggtcaagtttgataagctgacttcccacgacattacgttcgtaggaatcatacagacagcacgtgcatcgggactggagaagttcccgattccgtatgtactgacgaactgccacaacagtctctgcgcagtgggcggcaccatcaacgaggatgaccacatgtttgggctgacctgtgcaaagcgctatggcggaatctatgtgccgcctcatcaggcagtcattcaccagtttgccagagagatgctggcggcaggcggcaagatgatcctcggatcggattcccacacgagatacggagcgctcggtaccatggcagtcggcgagggcggtccggagctggtaaagcagcttctctccaagacatacgatattgatatgccgggcgtagtcggcgtttatctgacgggtacaccgcgcaagggcgtcggaccgcaggatattgcactggcgatcatcggcgaagtatttgaccgcggttatgtgaaaaataaggtcatggagttcgtcggaccgggtgtttccaacatgagtgtggactatcgtatcggtgtggacgtcatgacaaccgagacgacctgcctttcctctatctggagaacggacgatgcggtgaaggagttctatgagattcacggcagagcaggagattacaaggaactgaatccggcagcagtcgcttactatgacggaatgatcgaaatcaatctggatgagatcaaaccgatgattgcgatgccgttccacccgagcaacacctacacgatcgaggagctgaacgcaaacctgatggatattctggatgactgcgagaagcgggcagaggtaagctttgacggtgcggtcaagctcgacttaaagagcaaggtcagaaacggcagactgtatgtggatcagggtattatcgcaggctgcgcgggcggcggttttgagaatatctgtgatgcggcggacatcttaaagggtgcgtcgatcggaccggatgagtttacgctcagcgtttatccggcaagtacgccgatttatatggaactggtgaaaaatggagccgttgccacgttgatggagacgggtgcgattgtgaagacggcattctgcggaccgtgctttggcgcaggagacacgccggcgaacaatgcattttccatccgccactccacgagaaacttcccgaaccgcgagggttccaaggtgcagaagggacaggttgcttccgtggcgcttatggacgcgcgttccatcgctgcgacggcggcaaacaagggatatttgacggcagctacggacgtggatgtagatttttccaagccgaagtatcattttgacagtgcgatctatgcaaaccgtgtcttcgacagcaagggcgtggcagatccgtccgtggagatccagttcggaccgaacatcaaggactggccggcgatgagtgcgcttccggagaatatggtattaaaagtagtatcggagattcatgatccggtaacgacgacagatgagctgattccttccggcgagacctcttctttccgctcgaacccgctcggattggcagagtttgcactctccagaaaagacccgcagtacgtgggacgtgcaaaggagatccagaaggcacagaaagcagtcgaggagggcacatgtccggttgaggcagtcgaagaactgcgcccggtaatggatgcgatccgtgcggcatttccggagaaaacgtttggcgaagagatgaagccgggaacacttggcttcggaagtacgattttcgcggtgaagccgggcgacggttctgcgcgtgagcaggcagcgtcctgtcagaaggtgcttggcggctgggcaaacatcgccaatgagtacgcgacaaagcgttaccgctcgaaccttatcaactggggtatgcttccgtttgtcattccggagggagcgcttccgttccagaatctggattatctgtttttgccggacatccgcaaggcagtggaagaaaagcagagcgagattaccgcatacgtggtgaagggttctgagttaaaggaatttaagctgggactgggtgcgatgacggacgacgagagagagattatcttaaaaggttgtctgatcaattattatcgcggataagcccgtttcgtggcaataggatcagagagaacaggcagtgttaagaaatgcactgcctgtgtttttacagcggagtttgttttaactaaccaaaaagtttattttgttgtaaatacaacagactaattcctggtaccatggtaggatttggaagaaatagaaaacacggggttgtgtaacaatagaacatagaggaaaacgaccgcgtgtgtgaaatagaaaggagaaatgaatgatgatgaatccaagaaaagttgcagtaatcggatgtggttttgtgggggcgtccatcgcgtttgccctcatgcagaaaggactgttttcagagatggtgctcatagatgccaatcacgcaaaagcggagggggaggcgatggatttaagccacggccttccctacacggcgtcgatggacatctatgccggggactataaggatgtggcagactgcggtctgatcattattaccgcgggagcgaatcagaaaccgggagagacgcgtctggatctgatcgagaagaatgtcggaattttaaaatcaatcgttccgcagatcacggcgacggcgttcgagggaattttaatgatagttgccaatccagtggatgtgctgacctatgcggcacagcagatatccggttatccggtggagagagtctttggctccggtacggttctggatacggcgagactcaaatatcaggttggcagacatctggatgtggacagccgcagcgttcatgccgttatcatcggtgagcatggcgacagcgaacttccggtatggagcggggcgaatgtgtccggaatcgatctgaatcatttctgcgaactgcggggacatttcaaccacgaggcatccatggagcgcctgtatgaggaggtgcgcgacagcgcctatgagatcatagagcgcaagggtgcgacctactacggcattgccatggcggttgcgagaattgcagagagcattgtgaaggatgagcatgccgtgcttccggtgtcggtggaactgcagggagagtacggtctgtccggtctggcactcagcatcccgtcggtggtcggcaagaacggaatcgagaaggtgcttgagattccgctcaatgagaaggagaaaaatgcacttcttgcgtcggcagaccagctgaaggcagtcattgaaaaattaacattaaattagcggcaaataaagaatagcgattggaaaacctccctgcatggggtataatgtacgcataggcaaaagtgagcatgcatcgaaacggatgcagatgcttgcagcggcagccggatccgatgcatgtgaacgcgtcagcgggtccggaaaaccgtaggtttttcggaccttttgccgtaggcgtaagaaaagctgatagggcgaacgcccgcgagtccggaagagcgaagcggtttcggacgtgcactgcgagagcagaagcggcagacaacagaggaacagcaaggaggtttactatggacagtgagagacgacagacagacaatacttccggcgacagaaatggcggatggaatttaaagcaatatgtagtaatcgcgttggtagtgtttattacgttttgctgctgtatactgtttttctttatgatatatcgttacaacgggtttgcggatttctggaaaaagctgaccacaattcttcagcctattattatggggctggtgcttgcatatctgctcaatccggtaatgaagtttctggaacgtcatctgatgaagctgttggaaccgcggatgaagagcaaaacaaaagcaaaaaaaatgtcgcgcggcgttgcgatcgcgggggcgtgggtgttcttagggggaatcgttgtactgcttatcgcggcgattgttccttctatcatacagagtatacaggggatcgccacggggcttccgagcgaggtcaagaacatcatggactggtcggatgaattcttcaagggagattcggagattgtaggtgttataaacgatgtgctgcaaaaagcaagcgatgccgtacagaagtttcttgaaaatgatctgctggcgcaggttcaggtttatctgacgtcgatcgcaagcggtgtgatctatactttaaagtttctgctgaatctggtggtcggcatcattgtgtccatttatgtgctggcgagccaggagacgtttgcaggacaggcgaagaaaatcatttacgccatgttcaagccggtacgtgcgaacgtgatcgttgagacggtgcgcaagagcaacgaaatctttggcggatttatttccggaaaacttctggattcagcgattatcggtattcttgcctatgtggtgctcactattatgagaatgccggatacgatcctgcttgcagtgatcatcggcgtgaccaacattattccgtttttcggaccgtttatcggagcaattccgtcattccttatcgttgtattgcagaatccgctgcagggagtgtactttctcattttcatctttattctccagcagatcgacggcaatattatcggaccgaagatcctcggcgattctactgggcttagttccttctgggtggtatttgccattctggtatttggcgggctgtggggattcccgggcatgctgctcggtgtgccgctcatggcagtaatctactatgtggcacagaagctggtatcttattttctgcgaaagcggggtctggtggacgatacgggaagctacattcatctgatgcgcattgacaagaggacaaacgagcttgtctatgaggaaaaaacggagaaaggcaccgaggaaaaaatcgaagaatcacctgaaaaataatatgctgccctcatataggacaatgaaatataaaagtcctatatgggggtattttcatgtctggaaaaagtaagataattccaataaaaaaagacaggcagcacaccactgcgtgacagccttttcggacgaatatttttgacatctattagtgcgtatgataaactaaaaggtaataaaaagagtgaaaatcgcacagtttgaggtggcacaaattggataaatacgaatataaattaaagctggatcagatgaagtcctttaccgcagagaataattacaaagccgctgcggagattgcggacacgatcaactggcataaaataaaaaacgtcaacgcactgattaaggcgggagaaatctacgagaatgtgggaagatatgaggagagcagggacattctgctcatggcgtatgacagatctccgatcggacgaatgattatctaccggcttgcggaggttgccatcaagatggggaactgcgaggaagcgagagactactatcaggaattcgtggagatcgccccgcacgacaatctcaaatacgttctgcgctacgagatcagtaaggcggagggcgccgatctgcagacgctgatcggaatactggaagaattaaaagagcaggaatattccgaggagtgggcgtttgagctggcatgcctttaccataaggcggggatgagcgaaaaatgcatcgacgcctgcgatgagttgattctctggttcggagacggaccttatgtggagcgggcgctggagcttaagatgctctatcagccgctgaccagacagcaggaggaaaagtaccggcagttccgcctcaaaaaagagggcgttgtggaagtgcggccggaggacgaccttgagtccggcgagattgtgagcgaaccggtgcagataccgaaggtaaagctttcaccggagcgttttaatacacagaatctgcaggatgaacttcgcaagaatatggtgcagatcatggaagcgaccgacaaggaaaaggtcgaggacagcatggatacgatcaagaagctcgtggaggagattccgtatcttcagatccccaaggaggaaccgttgccgcaggatacgatcgagatgccccatatcgagacggatgcagagattgacaactcgctcaagagcaattttaaagagcttcttgcagaggattatgacggacagatcagcatgtatgttccggataagggggctacagagccgcaggtgacgggacagatgagtattgatgaggtgcttgcagactgggagaagaccaagcgtgcggcagagacggcgcttgaggaggcgaagcagcgcaagctggaatccgcgaaggcgcgtgcactgcaggaggcaggcgatatcatggagcgtctggtggatgtgattccgaagcttgactccggactgacaccgaaggatctgctggatgaagagtatctgggcggccagccgattgctgacgataaggcggctgagatggtggcgaacatgaaccagatcttacagcaggagatcgaccgcttatcttccgagaatgcgagaatggatgaacagcttgcggcggcaagtgcggcggaggcagcaggtgtggcggagccgcaggaagcgttgcagccggaggaggcagatttctgggggaacggcatcacagagctgacacagagcccgtatgagatagaaccaggtgcggagcagcttgcggcggaggctgcatatgaaccgcagacagatgcgggatacggagcagagacagagccggtatatgcaccggaggcagaggcggtatatgagccgcagacaggggcggtatatgaaacgcagacagatgcggtggtaagtgagacggaacaggcagatgcggcaggaagctatggcggaatcgcggaaccggagattccgggcagctataccgaagagacagacccggatacgtttaccctgggggccgatgtccaggcgcttctggcagaggaagcggtggcaaaagacacggcgcagccacaggcggcggaagaaccggaggatacagacgatgctgccgggatggaagagccggatacggcagcactgggagccgacatccaggcattgatggaagagcagaagatacagccggaggacgaggaacttccgaaggcggagaagtccggcggaaagctggcaggcgggggacacccgaagagcggagcttcaaaagcgaaagcggcagacgacgtgcttccgaagatcgaggagccagaggaggaaggacatcaggcaattacccggctttccaaagagcagcgggagatttttacatattttgtgccgattaagggaatggaacagcagctgtgccaggcgcttacgggagcagcggcaagactttcgtccggtaaaacggcttccaccgggaatatgattattcagggcggacagggaagcggcaagacggtgctcgcgaccagcatgattaaggcgctccagaaggaagtgggcaagccgaacggaaaaatcggcaagatcgaagcttccgtgctgaatcagaaagatgtggcggcgctccttaaaaaagtggcgggcggatgtctgattatcgaaaaggcgggagccatctcaagagagacggcagtcaagcttggcacgctgcttgacagtgacaacagcggattgtttgtgattatggaggacaccagaagaggaatcgagaaggcactcagccgggatgcgggatttgcagcacggttttcggagaaaatcaatatcccgatctttacgagcgacgaactggtggcgtttgcgagatcctatgccaacgaactgggatacaccatcgatgagatgggagttctggcactttacaacagcatcagcaatattcaaaagctggatcaggcgacaacccttacagaggtcaaggatattgtggacgaggcaatcgcccatgcagaacggggaggacttaagaaggcgttcagtattatcacttccagaagatatgacgatgacgattatgtcatccttcatgaaaaagattttggattttaaaatcaagataaaggggtagatgggtatggcaaatttttcagagctggatcggtacttatttgggcaggcgacacactatgagatttaccggaagctgggggcgcatcccacagatgaatacggcatccggggagtctgctttgatctgtgggcgccaaatgccgcgcgtgtatgggtcatcggttcctttaacggatgggatgagggcgccaatgaaatgaagcgcctggagccggagacgatggggatttttgaattgtttattccgggtgtcgaggagggcgatctgtacaagtacctcatcgagacgaaggacggaaagcgcctgtacaaggcagatccttatgcaaactacgcggagttaagacccggaacggcgtcggctgttgcggatatcgaacattttaagtggtcagatgccgagtggatgaaagagcgcgccacacacaaggaagatgtatatgaacagccgcttgccatctatgaggttcacccgggatcctggatgcgtcatccgggcagacaggatgacggattttacagttatcgggatctggcaaaatctttgattccgtatgtgactgagatggggtattcccatatcgagcttatgggaatctgcgaatatccgtacgatggttcctggggctatcaggtaaccggttattatgcgcctacctcgcgctatggaacaccggaagacttcgcttattttgtaaatgaatgccacagacacaagatcggcgtcatcttagactgggttccggcacattttccaaaggatgcgcacggtctggcagagtttgacggaagctgtctctatgagtatgcagacccgagaaaaggggagcatccggactggggcactaagatttttgattacggtaagaacgaggtcaagaatttcctgatcggcagcgccctgctgtgggtggagcattaccatgtggacggtctgcgtgtggacgcggtggcgtccatgctgtatctcgattacggaaaggaagccggtcagtgggttccgaaccagtatggcgataataagaacctggaagcaatcgagttctttaaacatatcaataccctggttctcggaagaaatccgggagctgtcatgattgcggaggaatctaccgcatggccgaaagtgaccggaccggtggaggatgacggactgaatttcagctataagtggaacatgggctggatgcatgattttttggattacatgaagctggatccttactttcgacgggataatcatcacaagatgacatttgcgatgagctacaatgagagcgaaaaatacattctggtgctctcccacgatgaggttgtacatctgaaatgctccatgattaacaaaatgccgggacttggcattgataagttccgcaatctcatggcaggctacgcgtttatgatgggacatccggggaagaagcttttatttatgggacaggaatttgcacagcttcgcgagtggagtgaggagcgcgagctggactggttccttctcgacaatccggatcacaagcatatccagaactgggtgaaaaaactgcttcatatttaccggaagaatccggcgctttacgagctcgacagcagctggggcggtttcgagtggatcaatgcgaacgatgcggacagaagcatctacagtttcatccgcaagagcaaggacggaaaaaatcagctgctctttgtgtgcagctttacaccggtggcaagaccggattacagagtgggagtgcctgccaagaagacctacaagctgatattggacagtgactccgaagagtttggaggatgtagcagacagcgtccgcagagttacaaggcggtggaggccgaatgtgacggcagaccatactcgatcgcgtatcctctggagccgtacggcgtggcggtatttcgttactgattgcatttcgggggctggtgaaatgcgaagaacatcttaataatggtgctgatatgaccgatatatatatcagctatgaatggcgcatagtgttatgcgccatttttatgcttcatattcgattactctatagaaccacagctgaaaaggtaaaaggagtgcacaggatgagagtagagcagcagagccagaatattatagatgttgtaaagcagagtatcggaccggaggaaaagagcggggccgttctgagccaatataccacaggagccgcgggagctgccgtggaaaaaagcagtgtcagtgacaatgcgaaatccgtgaatttaaaagatgccacctatgccaagccggcagcggaagacaagcagacggttgccgaggagatcgaagcgtccgcgacgcttgatgtcgaagagcgcaagaaccagatggcggtgttgtccaacactacctccccggaagattatgcgaaaatgcaggaagacggattttcactggacgatacgacgaccaatacgattgtgaccgagacggataagattaaggcacagcttgcaaaagcgggagtggatatctctttctttggagatgatctggattacgagcagatggcggcgattaccggaagcgaagcgcttgcaagacagctggcgcaggcaatgaaggaagccgatctcccgtgcaccgaggaaaatgtgcggggcgtgatggaggcgctctcactggcgcagacacttcagacgccgggggacggcgcagtgaaatatatgctggataacgggatggagcccacgatcggtaacctgtacaaggcagagtacagcggaagtgctgcttatcaggcaaatccggaggcagcagtcgatatgacgatgttttcggatcagattgacgcgattattgcgcgcgccgggctttcggtggatgatacatcaaaagaggcgtgccagtggctgctggacaatagcgtgccgctcaatgaggagaatcttgcttactatatggaactgaaaaatctcagtctgccagtgcaggcagaggcgctgctgggcagtatggcggctgcggttgcagaaggaaaaagcccgcaggaagcactgcttgtggatggacaatcatttgcggacaaggcgcaggatgcctgcgatgtgatcggcgaagcgacggatgaggatgtcgcatatgtcgtggatcacggcatggagttaaatatccgcagcttaaaagaagcgatggcacatcgctcgggtgaggagacggcggatagcgcttcgggagacgcgcaggaggagacggcagagagcagtgcggatggcagcactgcttatacacagagagaactggatctgctgaccgccagaagacagctggaggagacacgtcttgcgatgacagcacaggcaaactatgcgttgctcaaaaagggaatccagattgatacccagccgctggcagagcttgtggaggctttgaaggagacggagaaccaatattacgaacagctgttgaagggacagggtgtagaagcttcggagacgaacgtgaatcttttccgtgagaccacagagcgtgtcaacgatttaaaaacggtaccggcatacgtgctgggagcgcagggagtaaaggatgcgtctgtcgcagaggttcatgataccggacgtgcgatgcgggatacctttgagcgtgcaaatcagagttatgagaccctgatgacggcaccacgtgcagacctgggggattcgattcagaaggcattccgcaatgtggatgatattttgaacgatatcggactggaggcgacggaggcaaatcagcgtgcagtgcgcatcctcggttataaccagattgaaattacacaggaatccgtggcggagatgaaagcggcggatgagcaggtgcagcgtgtattccgcaacctgacgccggcaacggtgacggagatgatccgcagaggaatcgatccgctggatatggattttagtacgctgaatgcgacagcggagcagataaaaagggagactggcgcgaacgatgagcgcggcttcggagaatttttgtggaagctggaacgcacggagggaatcagccaggaagagcgggcttcttatatcggaacgtatcgcctgatccatcaggtagagcagtcggacggcgccgcggtgggagcacttgtaaatcagggagccgatatcaccatgcgcaatctgatgatggcggtccgatccgagaggcgcagtggaaaaatggattacagtgtggatgaatcctttggaaaagtggaaggcagtggatattccggcacttccatcaccgatcagatggaagcggcatatcagaacaactgcgtgaaagatgtcgcagatctgctcacaccggagcgcatgaaggttgtcgcatcacagacgccggactgggaggagatgactccggagcagttaaaggaggcgctcgcgcaggcacagacagacgatgccagccaggattatgcatatgcgaaggagcagctggatcagttatcgcagagcgcgaaaatgacgcaggatatttacacggtactgcagaagtacgacattccgaataccatgacgaacgtcatggcgatggaagccatggtaaatgaccggaacggcgtattccgccagatcttcggcgagagcgcaaagggaagccacaaagaggaaaatgaggagcagcttgcccgggcgaaggagcaggtgcttgaggatttcggagaggcaatcgcaagcccggagggacttgccgccgcacaggaacagcttgctgaggttgccgagaatgtaatgaagggaatgatcgacagcgatgacgtgacaagccttgatatcagggagatgcgtctgttgtcggcacagttatccatcggcagtatgatggcaaaagaagagcagtatgcaataccggtgcagaccgagagcggtgttgtcggcatttcgctaaaggttgtgcgcggggatggtgaaaaagggctggttgacatcacgatggaaaccaagcttcacggtaagattgcggcaacgttccaagcaaaagagcatggcgtcagcggtctgattgcatcggaccgggaggataccaaagaacttttagacagccggcaggagagccttacggcagtattggacagtggaaacgaggcagatcttcactatgcatgcatcgcagatctggatctgaaccatttttcaacaggcgtctttggcgtggatgcaccagaacagcaggagaccacagagaaacagtcggatacgacgtatcaggtgcagacaacaaggctataccatattgcggaaagctttgtgcggcaggtgcaggatcttttgcagggaacagatgcgcagggagcggatgcataaaacagttatagcagggattcttcttcgagataggagagaatccccagatagatggcatgagcaagcttgctctgataatcttcggtcaagagcagatcggcttcgctctggttgcttaaaaacccacattctacgattaccgtaggtgtgggtgttttttttaggagatagtagctttcgtttgccttggcgacgcgtgtattctggggatcgacttcagagatcagatgttcctggagaacgtccgctaagcgcttgccgttttcggactgcccgtaatagaatacctgggcgcctttgatgtcttcggttgtgtagctgttctggtgaatgctcacggtgaaagcgggattggcgtccgcgattatctggcagcgcttctgcatatccgcggcttttttgttggtggcgtctgcgggtgagagaccggcgtcggaatcacgggtgagaacgacagagatttctctctgttccagaagatcttttaattttaaagcgatggagaggttgatgtccttttcgagtgcgccgttgatgcccacctttccggggtcacttccgccgtgaccggcatcgacgacaatacagattttttcacgtgccgccttttcactctggaccagtacggcgccctgctttgcgagaatgaaggcagcggccagaagacagaggctcatgataagttccaacttttttttcatgaaataaaaaacccccggggattcgttcataaaatgatattcacgatccccgggggttagaacggctagttgatgtatttgataatggtatcccagacagccggatcctccagaccaagcttccagaaagctccgccggcgagctggttggactgcattacctttaacttctcctcaagtgaagtggcatcctccacccagatcttgtaggtgacgccgccgttgatgtattctacataatactgtccgtctgtgtcggaccacaccggaacggctccgttcgtgctgatcaggttctggacttctttcatgcctgccgagtagcagtccagctcgtagagtgtatcactgtcggaggtgtcctcggttgtactgacagccgcgccatcgtccgataccggagtctcgctccagacacgtgtgtaaaacggcataccgagaatcagctggtctgccggaacgctttggagcgtatctgcgacaccctgattgacaaaaccgatggacgccaccgatccggcttcctcggaacctgcgtaatgctcatcatatcccatcagtatgacatagtcggcaaagactgcctgttcggagcggttatagaatgccgtgtaagctgttggcggataattatcgacggaaaggacaatgccgttgttggcacatttcagcgataattcccggataaactggatataggaatcaccgatggaagggtcgagcgattcaaagtccacgttaatgccgtccagcttgtactggatcgcagcggagatcaggttgttgatcagactctcacgtctggaactgtaggtcagcacctgcgtggtatccggactctccagtccctgatccttggcgccgaagttgcttacaagcgcccagacttcaatgttgttctggtgacaatagtttacataatcagaacttgccagggaaccgatgcctccgttcgtatcctttaagtaaaaccaggtcggagagatgacattgagtcccttggtgtttgaaagtacgttcgcaatgtttgcgttcgcactgctgttggtcacctgatgccagccgagattgatggagaaatcttttttaatatgcgaaaattcttccgcagtgtagtcgctggtccgggtcgcggtggaagtgctgccgagggctttggtctttacatagccgatgatgccgtcctccgtcatcaccttcgtccaggtctcgtccggctctaaaaccgtgagcacggttccttttgcaaggtcggcgagaatcggactcttgatgccgccctgatagcgcagctccgtggatttcttgacaggagcggtgttgtagtcgccccactggtttgtgaggacaacgcggttcggctgatcgtatacggtataatcaaaatcggaatactgttttacgaaatcgatcgcaatatatgcggtggaggcatctgcctttacaatcgtgtgatctaacgtccgggcgtctttggtcacatagtaggtcgtgctctccgcatccgccgagatcaggtcggtggcggtggtgtataaaagcttgttctcattggcatcccagaaaaaacggctgttgatcttatcgtgaaccgtctcaaaatccagatatacgtttccgtcgatcagtcgcccctgcacagacaacacttcattattaaagatcagggctacggaatcatcagatgcaagcccgtaatactcggataactcctggtgttccttggagggcgtgtatttttcgatcagtcgcccgagcagcatgaacagaatgataatgacgattaaaacaagaacggcaatgaccggtataatattcttttttgtattcttcatggaaaaaccctttcttcttctgagagatttcccctacattgtagcatattgcagcacaaaatcaaagctatttgcatctgccattttttgcgtgccgcagaatgaaaaacgggaaccggccgcaggagattgtgaactcgggcggcagttcccggctgtctttttatcaaataatattcactgcatagacagtatgaccgggcattgaggaactcagtcattctgttccagttacgactagttacggaagatcttttctgatcttatcaaaatggacttcctttaacaccccctcgtcaaaaatataatctctcatgtacgtgctttcctcctgcacgcagagctggctggctacatcctgcgagctgcttttcgcgccctccagccagatggtaatgcctcgattctccagagacgtaagctccagatagagtctttgcatatgttcatcattcacattagattcccccaaatctgaaaaataccaaaaggaattcgctggttacgtttcgtgatataaaaaagatggatctgtctgatccccggcagacagtgtgttgcggttacaatgaataaaatgacagaagtatgtcaaaaaatagaaagtgctccttctctatatgaaaagggtttttgatgaacggaacctcctgcatggatatggagtgctgcctggaaaaaacggaatgattctggaatgttcccacctgtaccagataatgataaccttccccaaggtttgtaaagttgttaaattgtttgaaaaattcctcataactccaggttttccagagtgcaagactgcctagcacaatcttgcggtcacagcgcaggaattctgcggcagcagattcgtttaagctaccgagatccaggatcagataatcataccccatattcagcaggcgcggcacagcatccggcgccagattcggataataatccacgccgtgcagacggaagtgaaaaaactctgcctttgaagtgtccgcggtatccgccgctttgctgcattgtaaggcatggcggtgtatggagtccgcaagagcagattccggaatcagccgcgccagttcgctgcgcttgtgaagctcaagacaagcggtgcgcagtcttcgcctggaggcacagtatgtgctaaggcttatggcgagctgtgtcacgccagcccccggatgacatccgagaatgccgatggtgatgtgtgctttggtttcgttgcgatcaaaatagaagatgccgtctccctcctttcttcggtaagatggacgaaacaagccgttccttttcgggtgttgtatcgtatggaaccgcatcttccggaaagcagtagacgcggtgacctaactgccgtgcgtatgcctttgcggcagagcggcagccgtgattgcagagaaaacgtgtctgtggcagcagtgccagctgtttcccataggcggctgcctgtacaaaatcccagtctcctccgtttaagacgaaaagaatcaggtcaaaagaagccagctcggcaagcgcgggcgcgcgggtgccatagtcccttacaacgcagtcatccggcggaacggaaacagatacactgtccccatagtccggaatcccgcggaagcttccataaataaagatcccgttctggtcgatcagacgatgatttgccctggcggcgtgtagaagcgatgcgctcccgtccgcggcagcatagattgcgggaatatgtttttgattcatggtgctgacaagagaaatggaaatatgcgtggcgcctgcaccgggtctgctcccgatgacggcaatgttccgaatgagatgcgaagactgctgattctctgataatggtacacgaagcagtgcggctttcagatcgcaggcctcctgacagcggtctgccggatctgcagcgcacgcctgctctaagatgtaccgaagctgtctggaacagcggcaggacatggcgtccgaaagctccgttaaaaccctgccgagactgtagatgtcggcggccggagtgacgggctgtccgcgcaggatttccggtgcgcagtagcggcttgtcccgtaaagttggaaattttttccgaaaccggtaaaaaaagatgcaatgccaaaatcgagtaattttacctgatctccacataatataatatgctccggctttaagtcctgatacaggatcgggtatggagataaatgatgcagataggtaaaaatgtcgcatagctgtatgcccagttttacgatcagttcctcagaaatgcttttttgatgagagacaaacgtctcgagtgattcaccctgaatgtattcttcaatcatataaagataggcgtcatcttcgtcgatatcatatatgagggggattcctggatgattaagattcttcagaagagctgcttccgcgaggaagtcagattccagggagaaagaagatctatctgacagagatctggggattcgcttgatggcccgataaatcttcagcttgagatgctcggcgagaaatacggtaccgaaactaccggaaccgagtacggaaagaatccggtacttgccgaacagaataacttcttctatgcaaaatccgctcctttcatagtgtggcagattcgcatctcatgcatatgtttataacatgaaaaatgtagtttgacaatagctttttgacagtttataaagatttaataaaaaggtatactttacatcaatatagcatttgattataataaatgtacagtttacaaggttttccggataaaggaagtaatgcgggagtttcgcatgaaagcttggctttcagaatacggaaaggcgtggtgtagtatgaaaattgaaaaagtaaacgacaatcagattcgctgtacgctgacgagggaggatctggcagagcgtcagatcaagctgagtgagcttgcatacggaacggagaaggcaaagcttctgttccgcgatatgatgcagcaggcggcgtatgaatttggttttgaggcggatgatattccgctgatgatagaggcaataccgttgtcacaggacacgatcatcctggtgattaccaaggtggagtatccggaggagcttgataccagattttccaggttctccgatccggatccggaagacgtgtacgaggaggcaatggcaggcggtggagcagcaccggcgccggaaggtgcagatgacatactggggttgttccgcaggattcaggaagagcgcagaaaggcggcagatgcacagggcagtaaggatagcttcgtttcagaagagaatgataagaaaaaagaaactccggtaaacgtacttgtagacattacgaagttatttgtgttcagtgatttttctgagataaccagactggcgaacacgctgcagggcttctatcaggggaataacgatctgtataagaatgaggcggcgcacaagtattatcttctggtcagcaagagcagacagacaccggaagagttcaacaaggtgtgcaatattttatccgaatacggaacgcagcagacgtatacgccggcagcaggcgcgttcatgaaagaacactatcaggtgattttgaaaaatcatgcgcttcagacgcttgcagagctttaagggtcctgcggcgttaagcaacagaaaaaagggtattccggttccagtgggaaccgggatacccttttcgtctggtgtctgcctgcggattaagcgagatcctttgcaaggaaatcgttgatctcttttaccagagcgtccggatcgataccgtgtaccatggcagcctcttctactgtctccatctgggaagacgggcatccaaggcagtgcattccaatatttaaaaggattggtgcgatattctgatcgatctgaagtaattcgccaatcatcgtggactttgtgatctgtgtcataatgatacctccttatgtgattatgggcatgtatgattacattagtatgcccggcaatgtgctaattataatacgaaacgcggcggaatgcaaacaaagtttgcgtgaaatacacaggagtgcgggaaatcttttctgccgggtattcagtgaagcggcaagttggtcgatatataggacagatatggataaaggagaacgacaggatgagaataaattataatgtttcggcatcgatagcgaataagaatctgctcgggattgagagtaatttaagccagtccatggagcggctttcttccggtttaaaaatcaatcatgcaaaggataatccggcgggaatggcgatttcccgcaagatgaaagcgcagattgacggacttgaccgggcatccgccaatgcgtcggacggtatttccgtcattcacatttcggatggtgcgttaggtgaggtgacaaatattctgcagcgtatgagagagctttccgtgcaggcggcgagtgacgcgacgatgggtcaggaagacaaggaagctattcagaaagagatctcatctttaaaggatgaggtggaccgtatttccaaggataccgagtacaatacgaagacactgcttgacggctcgctggacaccagagtgtacacaaagcatgccagccgcatccaggtgacggatcaggtgagtccaggaaattacgagattaaagtcaaaacggcagcaacacaggcagaggtgacgtccggtgcagattttaacagcacggcggcaatcggcgtttccggcacgatgagcgtcaatggatcaaccgttgagatcgcggcaaccgacacgtatcaggaagtatacgaaaagctccggacggctggagagatcggcgagacacagatcgagcgcagcaaggcggacggaagcctgacattcactacagacgcttacggatctgacgccacattgaagctttccttcagcaatcaggcgcttgccaatcagtttgcactgtccgacgcatccggcaataacggtctggtgcaggatccggcgacaaaacagtggatttacggaagccagcagacagatgcttccggcaagacgacaacgagtgttccgaacggatcggacatggaattggatgacgtggcgaactggaagggatttacctcttccgcgaccgcaaagtgcgacggtaaccgtgtgaccatcacggatctgggcggtttttccctctcattcctggtggaagcaggatatgaggacggtgcgaccaagacagattctgccggcaatgtgttggagacctatgacggatccctcaaatttgaggtgacagatatgggaaccatgacgcttcatatcggtgcaaacatggatcagaatatgaacatccggattccggagatttcctgcgagagcctctatatcgacgatctggatgtgacgacggtcaatggtgcagaccgtgccttagaccgtctggatgatgccattgcaagagtcagcgaaacacgttcaaatctgggagcctatgagaatcgtctggagtattccacaaacagtctggatgagtttggggagaatatgacggatgcgatgtcgagacttacggatgttgacatggcggaagagatgacgaactatacacatcagaatgtgctcaatcaggcggcaatttctgttttgacacaggcaaatgatctgccgcagcaggtactgcagattctgcagtaggcgcgatgaggcatgagaacggaggtctgtcttgaaaaaagaacagattgtagattttaccaggcggatcagtcaggcgaaccggagcggactggtcgtggttatgtatgatatttttttcacatatctggatgatgccagggcggcatacgatgcagccgactgggatgcctacaaagaagcattgcggagagcgcagcgcgcgatcgatgaactgatatcggcgctcaatttctcctatgacatggcgaagaatctctacagtatctatgtgttctgcagagattcgatcgcaaagtctctctacaagagagatctggcagatgccgaggatgcctgccgcctcatgaaaaagctctatgacggctttgtgcatgcggccgagcaggatcattcggagccgcttatgaaaaatacgcagcaggtgtatgccgggtatacttacggacgtgacaatctggtggagacttgtcaggattccgatagttccagaggatttttggtataaaaatcctctggatttttttgtgtgcgcaactcatagttgcggatgcttgtaagaagaaatttgtagcgcatctgcacggaatttaattcataaatgtaacagtcgatcagatccggatcgatgacgttttccagattgcggtaggcgtcctgcagatcctgtgccgtctggtgcagatcgtttatcagcagcgtataatgattatcattcgttttttcgggttgaaaaaaacgcagcatagttcctccagatctatgggttctgccgaagtctgcggcagtgttgttccttctatcttattcaaagtataagcaaataaatcccattctatacaaaaaacggtaaaaatctgtccgtccgccggaacagacaaactggcataaacggacgcggacattcatagatatagaaaaaagtgtggaggaaacgccatgcaggaaatgtcgctgacatcattctggatcattgcgggaagctgtgtgctggtccttggaattatgatattaaaaaatcgtgcaaggtttgcattaaattttctggtgcgcgcggttctgggtgcctgcgccatcgcatgtgtgaacaaatggctcgcacagcagggaatcatgcttgccgtcggcatcaatccggtgacccttttgacaaccggaagccttggttttagtggggttgcgcttctttatggaattttgctgctcaaaattttgtgagaatcttacaaatgtaaataaaatgcgaaaaacctatagacaaagcaaaaatgaattgctataatccgatttacaaatgaacgaaggggtggtgagttggggaacttatgacactgacgctgttgacggtacttgcatttgcggtcgcagcggacttccgggagatgcggatcagtaaccggctgattgcttccggacttatgatgggacttgcactgcgcattctgggggaaggcggtgcaggcattgttcatttcctggtgaacatttctattccggttatcttattgtttcttttatttcaactgcgtgtaattggcgcaggagatatcaagttattttccgtagctggtggatttctttcaatgagacagttgttatatgtcatactggcggcatttgtgacggcagcagtaattggactggggaagctgctgtatcagaagcgaatggcgggaatattcgggaatcagagaacactgattcatttttcagcgatgattttaattggatattttattgtagtctgggggtgtgccattgaataaaattgcggtggcagtctgtgatacagaccgggaataccgggacagatttgtcacatacctggtggaacgcaaggcggaagaatatgcagtatccgcattttcgatgccggagaagcttttggaagcgttggaggaagagaagccggatcttgcgatatgcgggaccggatttgaagagatggcggagagactggcgggatacgatattccggtgctggtcttgcaggagacgatggcagatgcggttgcggaatcggtaacgtacggttccgtgccggaaagctgccgtggaatctgccgttatcagtccatggaggtcattctgcatgaggtgcaggtgatgactctgacgggagccggcagcagaaggatggagaatgtcggaacgggaatggaggtaattggtgtttattctccgatctgccatgaaatgcagatgccgttttcgatggttctcgcacagaagctgtcgacggagaagaaggtattatatgtgaatctgatggaacattccgggatgctggagctgcttggcgttccgggagaatgtgatctgggcgaggtgattctcgcattgcgcaggcagcgccttacggcggaaacgcttggcagagggattcatgagaccgagtggatgcactatgtagaaccgtttgataatccggaggatctgggggagatgaccgcgggggatctgcaggaactgatctcctttctggagaagcagacgtcatatgagatcctcctgttggattttggtcaggggttaagggattttctatcctttctggggctttgcaccagtatttattgtccaatgaagagcggcttttactacgactgccggatggatcatttccgcagatacctggaaagagagcctgcggtggacattgcagaccggatgcaggtgataaggctcccgttttctgcaggaaagatacgtgcgggaatggatgtgtaccgtcagtttttgtggagtgaatttggggactatgtccggaaccatatcggtggacaggaagaataagaccgggacagggggatgcgcaatgcagattgcgggagaagagatagaacggctgcgcagacagatcatggagcagatcgacctgacgcggacggtggaggatgaggaggtatatcagctgatcgaagcacaggtaagggactttgccagagagaggatgcttacgctgggggagcgggaagctgtggtacagaccttgttttattccctgcgcaagctggatgtactgcaggaactgctggaagatccgacgatcacggagatcatggtaaacggtgcagaacatatcttctacgagaaagcgggacggctgtacaaagcggagtacgggttttcctccaaagaaaagttaaatgatgtgatccagcagatggcaggatacagcaaccgtatggtgaatgaggcatctccgattgtcgatacccgtctggcggacggttcccgcgtcaatattgtgctggagccggtggcgatcgacgggtcggccgttacgatccggaagtttccggaaaatccgatcggtatggaggatctcatccggatgggaagcatctcacaggaagcggcagatctactgaaaatactggtgcggtgcggctacaatattttcatttccgggggaaccggttccggaaagactacctttttgaatgcactttcccagtatattccccgcgaggaacgtatcattacagtcgaagattcggcggaactacagcttttggacaagccgaatctagtgcggcttgagacgcgcaatgccaatacagaaggcgttacgccgatcacgatccgcgatctgatccggacggcgcttcgcatgcgccccgagcgcattatcgttggggagtgcagaggcgcggaggcgctggatgtattacaggcaatgaataccgggcatgacggaagtctctcgaccgggcacgccaactcgtgcaaggatatgttaagcagattggagacgatggttctgatgggcatggaactgccgcttcccgcgatacgcagtcagattgcatcggggatcgatatcctgatccatctgggaaggctgcgggataaaagccgtaaggtattaaaaatagtggaaatagcaggaatggagcagggcgaggttatgctccatgaattgttcaggtatgaagagtccggggaggaggcaaggcatgtgaggggaaccctgatgagaaccggccggctgatgcataccgaaaaatgtgagcgtgcaggaatgaacccggagaaggaggggagcagtggactatagaaaataccgggcaggttttgtggagaaactggcttgtgcggcagtgggagcaggagcggcaggaatggcagcgtggctgttttaccggtctgtgtggggaatgctgctgtttccggcagcgtacctggtatgcgtgaaaaagtattgcactctgcaaaaggaaaagagaaaggaacagctgctcatggagttcaaggatgccatgcagtctgcatcggcggcgctgctggcaggatattctgtagaaaatgcatggagggagacggagaaagaacttctggaattgcatggggagaagggatttatggcggcagaggtgcgctggatgaatgagggggtgcgcatgaacgaaccattggagcgactgttgctttcgtttgcggcgcgaagcgggtgtgaggagatcgagagttttgcggaggtgttcgcgtttgcaaagcggagcggcggagactttgtccacattatgcagacgacggtacaaaaactcgcggggcggattgaagtcgaaagggaagtggcaaccgtgcttgcaggaaagcgtctggaggggcggattatggaaataatgccgcttgcaattctggcatatcttcaggtggcatcgggagaatttctggacgctttgtatggcagcgcattcggagtggctgtcatgagcatcgctttttgctgctatcttgccgccatcaaatggtcagagcatatattgaatattcagatctgacgaaaggtttgtggataaagagggggaaaatgtgattgtatgtggaatagcgcttggactggcggtgctcggatgggcagtcagccggaaatggggcaggaaagactggcagaaaggggcggcagtcattgcggcagcggcatgtctcgggctgctgtccggatacatggaactgcagacagatgaggatccggagaaggggctgcttcggagagaaaatggagaaggtgactacgaggcagacctgcgtatgtatgtggatggggcgaaaaaggccaaagcttacaaggtgcatgtgccggagcaggagctgacaaagcaggaggagcaggcatatcttcgagcggcagaggaagaactcattaaggaattcccgggagacaatgaatctgtgaattgtatacgggatgctgttgtcattcgtgaggaatatcaggaagggcatgttgaggcggaatggagctttgacaattaccggctgatagagagccgcactggaagaattgtgggagaaccggacgaggagggggagctggtgaatgtgcaggtcactctgacatgtggaaaatccagatgtgtacaggagttttatatctgcgtgtatcccagactgttagacgaggaagagcgcttccggaaggggatttcagaaaagattgcgcgacagcagtcggaggcgggagcagacagactttttctgccggatgaggtggagggacataccatacactgggagcaaaggcgcgatcagagaccggaaaagatccttatactgggcgtgattctcgcctgctttgtaccggtggtatccatgagcagaaagcaggaggagcaaaagaagcgcaaaatgcttctggaactcgagtatccggatctggtgagcaagctggccttgcttctgggggcgggaatgacgcttcagggagcgttcagaaaaattgccggagcttatggacagaagcggacacagaataaaacggcggaaatgcccgcctatgaggagatgctggtcgcctgccgacagatggagagcggtgtgggggaacagcgggcgtatgagcatttcggagaacggtgcggtgtggcatcctaccggaagcttgccggcatactgacgcagaatctgcaaaaaggaacccgcggtattacggtactgttggagcaggaagcgcagaatgcgtttgaggagcggaagcatgccgcaaaacgttacggtgaggaagccggaacaaaattgctgtttccgatgatgctgatgctcggaattgtgatggtgatactgttggtgccggcggtgctggcatttcaaatttagaaagggagggattctatgagagggatcagagagtttatcagagaagaagacggtgtgggagttgtggaattgattctgattctggtcgtgttgatcgggctggtactgatctttaaagatcaacttacaagtctggtgaacgatattttcgatacgatcacgaaaaaggcgggaaaggtctgagaatgagaaagagagcaagtattacggtattttccgcacttgcgtttgcgctggtggcatccttccttatggctcttctggaggcggggagggtgtaccagatacagacgtatgcagatatgaagtccacgcttgcgctggagtcggtatgcgcagagtatcagccggtgctctgggaagaatttcatctgctgggactggatggcgcctacggtggggatatattttccatggatcatgtaaccgctgttttaagagagcggcttgaccggaatctggacgttgatggagcgggaggaagcatcctgcaggtcacccttgcaggagcagagccggtggcataccgtctgatgacggatcaggagggaagcgtgtttctgcactgtgtggcagcatatatgaagcagaatatggcgatggagaccatacgggcattacaggaacgctatggcgagcatgagcaggtggaacagagcggacagggggaagagagtatcgaggatgccagaacagcgatcgaagaggcaaaaagcgaacgccgggaacaggcagaatcggacgggacggaagcggtgataccggaacttccgccggagcaggaaaatccgctagaggttgttcatgcgataaagcagaacgcactgcttggaatgacgctgggggattttggtgcggtctcgacgaggcagaccgatctgggtgattcgatagagaggcggcagaaacagaccggcaatatggaaatacaggtgtcggactggtatgacagaatactcgcactggaatatatggatcaatattttggagattatctgggagaatcagaggatcacgcgctggcatatgaactggaatatgtgctggcaggaaaaggatcggataaagagaatctggaaagcgtcatcaagcgcctgctgtttgtccgggaggcagccaatatcacgcatatcctcggagatggggacaagcgggcaaagacgcttggaatggcggaggcgctggcgggatttacgggaaatcctgcggttgtgcggcttgtccagacgggggtaatcgcggcgtgggcgtatgtggagagtattttggacatccgggcattgctggcgggggataagattgccttgataaaaactgagacgcagtggacagcgcagtttggcagtcttgcggcggcgtttgaagacggcaaaaaggcaaaaaactgcgaaaacggtgtgagttatcagggctacctgaagggattcctgtatacagtgtcatcagagcggctggcgtaccggatgatggacatcatggaacggacagtacgcctgcatccaatgtatgcagactgccgcatggatcatgtgctgtgtggcataagttaccgcatggattatgagtggcagccgttgttttccgggctgatggtacatacagggagagatctgtccggtctatgctatcagacacagcgaacgttttcgtatgattgaggagggaggtgttgcggtgtctctttatgaggtagaagcaaggcgaatcataaaaataataagaaaggacaaatctctccccgaacaaaattccatatctggttcagaaaatatcgcgcgaaaagggacaccgcaatgcctccgtctgtctgcagtatttacactggaggcagcagtcgtgatgccggtgctggcatgcttttttgtgagtgttctctttttcttccgcatcatgcagattcagcttgaggtgcagagggcattggatgatacgggacggaagctggcagtctgcgcgacaactgtgtcatccgacggggcggcgctccctggaatggcagaggctttgcttttgagagagatggcggaccgcacggaagcagaaacttacatcacaggaggaaagtttggaatcagcctgattggatccgatttctccggggaggagatcacactgcgggcggcgtatcatatccggctgcccatccggatcttctggttgtgggattttgcgatggaacagcgggcagattgcaggaaatggacaggatggagtgctgcagagggaagtgatgaagaccagtgggtgtatgtcacacagacaggaaccgcctatcacagggagtatagctgcacgcatctggagctgtcgatccggtctgtggcggaggcggaaattgcggcacttcgcaatgagaacggggaagcatatagaaaatgcatgcagtgccggtatgcggaaaatgcattcggacggctctatattacgaaccagggcgactgctaccacaaagatcttggctgcagcggcatcaagcgaaccgtccgcatgatacggctgtccgaggtgggaacacgcagaccgtgcagccggtgcgggcagtagcgggagagagatggatgagaggagaagaaagacaatgcagaattgtgtgggtgaggtgttgctgcttggaatatttgcggtcacggcataccgcgactggaaggaacagatgatatgcgtgtatgtgcctcttgcggcgggaattgcaggactggttcttcacctgatgctcccgacacagaagctgacggatctgctgttgggtgcaggaatcggcgcggtgcttttgcttgcggcttgggtcagcagggaggagattggctacggggatggcgcaatgctgatggcaagcggtatttttctgggattctggcggaatgtggagttgtttttaacggcgcttatgttgattgttccggcggcgttgtttggactcattgtgaagcatagaagaaaggattaccggatgccgtttcttccattcctttttgcggcgtatgtatttcagctgggatggcggtagaaaacgggacgaaatggagaatttatgaacggatggagaggaagtctgaccatagaggcggcgcttgtggtgccgctcgtgctggcgttgtttgcattcgccatgaagagcggtattcagatgtatacagagtgcagggacaccgcgctggcgatagggcaggagcaggaaatagaggcggtaaagatgttttaccgctggcaggaagcgggggaattatttcaaaatgaagatacagtatattagaaaactgacggcaagctacatggtgctcgcgcagtgtgaagaattgcaggaatgggaaaaaaagatgattgctcatgctccgaaggggaatattgtgtttgcggaatgtgtgcaggagaacggagaaaagtatctgtggtataacattacaggaaaacaggcgctggatgcggtgttggagacggagacgttttcctatgatatgttgtgcaatgtactcaacggaatttatgaggcagtgcagcagttagagggaatgctgctgccggcacagagtattctgttgtcggcggaaagtattttcgtagattaccggaccagacagatttctttctgctactatccggggaatccaatgccgctgccggaagccttccggacgttcatggaatatctgctgacacgactggatcattcggatgagcgtgcggtcaaagcggcatatgatatttacggacagagcagtgcagggggaatggagttaaaggagctgaaatcgctgcttttaatgccgtatgaaaaggatgaagcgaagacagagccggagggtctggatgacacagaaccggaagagccgaaagcatatgccactgtcggacagaaggaacaggacgggaagcgggatgcttccatatggaagcagatttttcgcggagagagcacggtgcaggaactgcttgcggcagtgtgggagaaaatatggaaaacgacaggcacagctgcaggcagaccggcaggtgaaaaggcaggcagaccggcggacgaagcggcagcatccggggacaaaagaagaacgggcagatggaagatcggcgggaatatgaaaaatatgcagaaggagccggaggcgtttgtctttgaaccggaggaagaggaacataaatccgcaaatcccacggtgcttttggcgggaatttcgcagaaaccggaaggaatcctgcgctacgaaggaaccggcggatactcggatctggtgatagagaaagacaactatgtaatcgggagtacagcggagtgtgatggccggattccgagtgcgaccgtgagcaggaggcatgcaaagatcagcaaaaagggagctgtcttttttatagaggatctcaattcgtcgaacggcaccagagtgggtggagaattgctgaattataaaacaggaatgagtctgcagaaaaatgaggtcgtgatgtttgcagatgaaaagtttagatttatttaagaaaaaatgagggaagtacgtttgcaatctgcgcccggtctaactataataaccatattataagagtgcagacagaggtaacgcgtatggaaaatgcagcagtcgcaaatgtattaagaggagaaggctaccgctattgtcacaccaatctggcggaagccggaatttattataagtattatcaggaggggttccatattgtaatggcggtagatctctccggcggaaaccggttctctgtgcagcagtaccggagcatggaagaacacgccatggatctgttctatcacccgcaggggagacttggggatttcccggatggatttccggtatatcatgtggagatgctgacacttctgatcggcggagattccgaggtggaacgaaagttgtgcgcagagtgcaggaatgtgtgggtatatcagccccaaagcggacggctgctgatttatgagaaccagccgggagactttttcggactccggggggcattagagcagggtgccggaacaggcggcgcgggagagacgtcgcggcagggtaccggagccggtggctgggcagagacgtcgcggcagggtgccggagcatgtggctgggcagagacgtcgtggcaggacacaggtaccgcatatgcatctgcacagaatacggcaaagaaccggttgggcattttgtggaagaacatccgggcggaatatgtgaccatcgctctcgttactgtcaatgttataacatatcttgtgcttgaatggctcggagatacgacgaacggattttttatggcggagcacggcgcgatgtacccggattttatccggatcaaccatgaatggtggaggatcataagtgctggcttccttcatttcggcgcggtacatctggtgaataatatggtgattttatactgtatgggatcaagactggagcgtgtcacagggcatctgaagtattttttgatttatctggtttccctgatcggggcgggactgctctcctacgggatgatgcttcgcaccggcgattatgcagtgtcggcaggagcttcgggtgctattttcggagtgattggcggattcctgtggatcgtgatactgcaccggggcagatttgagcagattacaacccggggaattatgatgatgattgtgcttaccatctattacgggttttcctcggcgggaattgataactggggacacatcggaggtctgcttgccggatttgccgcgacagtcattttatatcacagaaaccgtcaaaaatattgattttgtgagcaaaaatttatatactgaaagcagtatgttccataaagcgacagatgggacaaaacggaggctttgaatgaaagtaaatatttattacggtggacggggactgttggacgatccgacactttatgttttgaataagatggaagaagtgctgcgcgaactgcgtgtgacggtcgatcggatcaatatctatgagcacaagaatgaaatagcgaccctgccgcagacgatgaaagaggcggacggtattattcttgcgaccacgatcgagtggctcggaatcggcggctacatgcagcagtttctcgatgcatgctggctgtacggcgataaggagaagattcagacgacctatatgcagccgatcgtgatgtctacgacctacggggagcgtgagggtgagatgacgctggcaaatgcctgggagattctcggcgggcttccgtgtccgggactctgcggatatgtggaggatctggtgtcgtttgagatgaacaaggactacacggtcatcattgagaagaaggcggagaatctctaccggacgatttctcagaagatgaaaagtctcccgaacagtaacctcgcggtcagacagagtgtgctgcgcacaccgcagatggaactcactccacaggaaagtgagcagctgtccaagtatgtatcggatgacagctatgtgaagaagcagaaggaagatattcaggaactggcatccatgttcaaggatatgcttggaaaggtcagccaggaagaggatgtagcctatatcgatcagctgcgcaatgcgtttgttccgcagcaggattttcatgccagatatctgtttatgtttgcagataagaaaaagccgctttttattgaagtgaaagatgaggatctcacgatacaatatggtcaggaagagaatattgatatctatgcaaaactgacgccggaagtaatggatggcgtgattgccgggaggatgacattccagagagcctttatgacaggcgagatgactgcgaagggcaattttaagattctgcggatgctggataccgtgttcaattttgcgtaagaggaagtgcgatggtgaaggtgcatccgtcacccggtctggaatcgcaggttaatgtaccgtggtgtgattcgatgatctgacgggtaatgacaagtcccagaccgctgcctcccgttttggaggtaataaaaggctggaagatggtatccgccagagccgggtcgagtccgccgccgtggtcagtgatggcaatgctcataaagggttcttcataaaagacgtggacatcggtagtgccactctcatgcatggcttcaaatgcatttttgataatatttatgacagcttgttttaaaagctgcggatccagttcgatcaggggaaggttctcttcaagctggaagttacagacaaagttcttccaggatagtacacggatggaagtgtcgatctgatgcataaacgaataaatgcttacctgcatcagattcagttgattgcacagccgcgcagaggacagctgaatgaccatgtttttcagaaaacagagttccgacatggattcactccagtagtcaaattcccgcacttcagggtgtttcttttcaacgagctgaagggagctgtttatcaacgtaatagaattttttatttcgtggaaaatatgaaggtaatcctcgttgcttaacaatgtaatccctgccttgttgatctgatttaacacgtgacacaacttagtgtagcatttatacaaaagaagttcaataacaaccagtttacaaaattcgacaggtgtaagaaaggagtaatcatattatgagacaagcagactgtattttttgtaagattattgcgggagagattccgtccaacacgatctatgaggatgacacatttaaggtgattctcgatgcaagcccggcgtcaaaaggacacgcgctgattcttccgaagaagcactatgcggatatctatgatatcgatgaggaagttgcaggaaaagccatgaagcttgccaagaagcttgcaggacatatgacagaggttcttggctgtgatggatttaatattcttcagaataatcacgaagttgcaggacagacagtattccacttccatatgcatctgattccacgctatcagaacgcggagaataacgacattctgatgtggagccatgagaacttctcggatgaggagatggcacagatcagagattctctgagccggaactagaaacggagcatggctttggattagaaacgatcattcaaaggaactgccacaataagcatagacctctttgggatgataagtaatattatcagaagatcacttcgtgagatttcagatggaaatgcagatggaaatttgttggagaaaaatgtcagcatttcttccagctgaatgtttgcatcggattccgtgtctcttccacgtttggacaatccgacgggtgcatgtccgacacaccggagacaatgggcggactttctggtgtccctaatggcgcctcttcacagacaatataaaaccgcgcgaaccgaaactcgttgccatctgctattaaaaatatggcagatggcaactcagacatcggcttcgcgcggttatgttttgttcagaggtgccataagggacacacacaaaagtcctacaaattgtcttccgggatgcggacatgacccgcggagtgctccaaacttggaaagacacggatcatcgaagatgcaaacatccggctggttagaaatgccacattttttgaacccaatttccatctgcattccagctgaaatccccgagtgtgtttcttataatattacttatcaacgcaaagcacaatatgcttattgcggcggggtctttctatgcaggaacctctatttgtgtgaagatgcctcgcggatcagtcccatgatcgtctcgatggagtttgtgaccttgctgtgctccatggcatcgatataagcgtcctttttgtggaagacatggtcgatggcttccaacagtgtggtgttggtcagttcttcctcctcaagaacatagctgaatccctgggaacggaaagagttggcgtttaagatctgatcgccgcggctggctgctgccgggagcggaatcaagatattcggtttgcgcagtgcgagaagctcgcagattgcgttggctccggcgcgggagatgacaagagaggagagtgcgaacaggtcggcaagttcctcgttggcatactcaaactgggcataaccggcgatggcgttcagggaagtgtctacatttcccttgccgcacaggtgaatgacattataattttttatcagctccggaagcagatcccggatggcggtattgatggcacgggagccgctgcttccgccgacgatcagaagcgccggttttgcggaatctgtaaaattgcagagtgcaaaagcgcggccggcatctccggacagtaattccgcacggatgggcgtgccggtaagcacggctttatcctcgggaacatgtgccatcgtctccgggaaattgcagcatacttttgtggcttttggaatcgcaatgcggttggcgagtcccggcgtgagatccgattcatggatgatcgcaggaatatggcagcggcttgctgcaagcacaaccggcacggagacaaagcctccctttgagaaaacgacatccggctttaactttttcaaaagacggatggattgatggtagccttttaaaactttgaacggatccgaaaaatttttcggatcaaaataacgtctgagctttccggacgagatgccgtaatacggtacaccctgctcctcgatcagccgtttttcgattccctcataggaaccgatgtaggatatttcataaccttccttctgcagagctggaaataaagcaatattcggcgttacatgccctgcagttccccctccggtcataacaattttcttcatagtaagaatccctttcctcatggtctgcttcccttatttataatacccttatgcataaaagtcaagaaaagacttggagatcggactctgcggcggcaatggaaaaagggtgtggataatgctggcacggtatgtaaaaagaatgtcgcaaattgcggtgagatcacggggaaatcctcttttcaaattcgtgcaggtttcttataatatagaagaaatcggacagggaaaagtctgatcggaaagagaggtaatggacatgctctggctggaacatatttcaccggaacagttgcagatgggagctgcggtatgcaatctgctcaccgtgatgcttctgattgtcacattacataagataaacagaatccagagatatatacagaagaaacagaccggcacggacagaaaggagagcatagagtgcggggaactttctccgacgcaatgcgattcacaatgtaaagaagcagctggtgaggtgaaaaaatacccggcggacatgctgattgatgaggttattgaagaggtattttcttaagaaaatcttcataaaaacgaaaaactggcaaaatgcacaaaaaacagccggaagtcttgtaaaatggggcttccggatgcctctttctatagaaaaacaacggcatgaagacgcggaaagccccgaaaacttgacaaaaaacagtacctttgttataattcctgctgtaacaaatccgtaacaattgtaacaaaatatgaataaaacagcacaaaggtgtaatactatttcaataaacatgtgattacaccgatggagggttctatgagtttgaagaaaagagcgattgagggaatcgtggttgccggatccctggtgatgatgagcacaatcgcacaggctgctgatcttgacggagtacaggtaaggaacgcagcggtacaggcagagacggacttcgctacagggggaacagcaggagttgttgcccggttagatcagttagaagcagaggcatttggtgatattgaagcggcgacagccggtgtgaaccagacaggaagacttctggttgctacagcggaggaagcggtttcggatacagaagctgcggagacattagatgcacagctgcagcaggccgaagcaacagagacacagcaggcagatgcagcacagagcgagacagaggcagcacagagccaggcagatggcgagcaggcagcggatgcagagcagacagacgctgatgcgcagtcggaggatgcacagagcacggacgcagatcagatgtctgcggaagagcaggagtggcagaaccgcctgatggcagatgtcgacgatttcctgtatatcagggaatccggagacgaaaatgcagcgattgtcggcaaattatacaagggagatgtggcggagatcgccgagacaggcgatacctggacacatgtggaatccggaaacgtagacggatatgtgaaaaattcctactgcgtgacgggatcggaagcatatacctatgcgaacgatacatttgatacagaggtagagatccagacgaacggacttcgcatcagaagcagcgcagacccggacgcgtccgtgctggcagcggtatcgacgggaatgacttttccgctggatgcagatgcggagaccgtagacggatgggttgcgattgattacaagggaaccaccggttatgtgagcgcagagtatgtgacgacggagcttgcactcggtgaggctgtcacgatcgaggaggagcaggcagcagctgcgaaggctgcggcagaagcggcaaagtcctcacaggtgtccagcgcgggtaccgttcagaattctgcagtgtccgcttcggtggatgatgtgacactgcttgccgcactgattcagtgcgaggcaggaaacgagtgctacgaaggacagcttgcagtcggtgcggttgtcatgaaccgtgtgagatccggcagatatgcgggcagcatttacggtgtaatatatcaggcaggacagttcccaccggcaggaagaggagccgttgcaagcattgctgcaaacggtccgaagtccagctgcattcaggcagcacaggaagcactcaacggtgctgacaatacgggcggtgcgacatgctttagcagagcttcttccggacacgcgggtgtggtaatcgggaaccacgtattttattaaacaggaatcatggcagagccgtgggaaatgatgagacatttcctacggcttttcttgtattttcaaatcaaatatagtaatatgatatttaacggggaaaattgtgttagagatccgggcagaaaagaattggaggttagataatgggaggattattagtagcatttttgattttggttattctgatattggcagttgtggtgtcctgtattaagatcgtaccacaggcgcatgcgtatattgtggagcgtctgggcggatatcttgcaacatggccggtaggtcttcatctgctgataccgtttattgaccgcgtggcgaagaaggttaccctgaaagagcaggtggttgatttcccgccgcagccggtaatcacaaaagataatgttacgatgcagattgatacggttgtttatttccagatcacagatccgaagctgtatgcatacggtgtggagaacccgctgatggcgatcgaaaacctgaccgcaacgacactgcgtaacatcatcggtgatctcgagctggatgagacactgacatccagagagacgatcaacacgcagatgagagcaacacttgatgtggcaactgatccttggggcatcaaggtaaaccgtgtagagcttaagaatatcattccgcctgcagcgatccaagatgcgatggagaagcagatgaaagcagagcgtgagcgaagagaagcgatccttcgtgcagagggtgagaagaagtctactgtcctcgtggcagaaggtaagaaagaatccgcaattctcgatgcagaggcagagaagcaggcggcgatcctccgcgcagaggcgaagaaagaggccactatccgcgaggcagaaggtcaggctgaggcaatccttaagattcagcaggcaaacgcagacggtctccgcatgatcaaggatgcggctccggatcagggtgtcatccagttaaagagccttgaggcatttgcgaaggcggcagacggcaaggcgacgaagatcatcattccgtctgagattcagggaatcgcagggctggcaaaatctgtgacagaaatagctctggagaacaaatagaacatcggatagatcagattgaaaataggggctgtcacgaaagtggcagcctgtttattctgcaacaggaagcacaaagcgacaaggaggaacgcaatcatgaacttaaaaggacgcaatttcttaaaactgatggattacacaccggaagagattctctacctgattgatctggcagcggatcttaagagcaagaagaagcagggaattctgcatgatagtctgatcggaaaaaatatagcgctgattttcgagaagacaagcacccgcacacggtgttcttttgaggtggcagcacatgatctcggaatgcatgtgacttaccttgatccatccggttcgcagatcggcaaaaaggagagcattccggacacagcgcgtgtgctgggacgcatgtttgacggtatcgagtaccgcggatacggacaggacattgtggaggagctggcaaaatatgcaggggttccagtgtggaacggtctgacgaacgagttccatccgacgcagatgcttgcagatatgctgacaatccgggaacacctgggccacttaaagggtgtgaagtttgtatacatgggtgacgcccgctacaatatgggcaattccctgatggtgacctgcgcaaagctcggtatggattttgtcgcatgtacttccaggaaatatttcccgaacgaggagctggttgattactgcaaaaaagtagcagccgagaccggagcatcgatcacgctgaccgaagatgtggcagagggcacgaaggacgcggacgttatttacacggatgtctgggtatcgatgggcgagccggacgaagtctgggcagagcgcctacaggatctgatgccgtatcaggtcaacaaggcagccatggcaaatgccaagccgacggcgatcttcatgcactgcctgccggcattccatgacttaaagaccaagatcggcaaggaagtctatgagaaattcggttacagcgagcttgaggtgaccgacgaagtatttgagagtgagcagtcggttgtatttgatgaggcagagaaccgtatgcacacgattaaggcagtcatgcttgctacactgggagaataagagggaacatcatgaaagcagaactactttccgttttaagagatgccgacgattatgtgtcaggacaggatctgtgtgaaaagttcggagtatcccggacggcggtctggaagggcatcaaccagctcaaggaagccgggtatgagatagaggcggtgccgaacaagggatataagctgttgtcggtgccggacacactgagtgaggaagaattaaaaagtatccgtaagaccgcgtgggtgggacaggagattttttactatccggtcatcgattccaccaataccagggcgaagcagctggcggaggaagattaccctaccggaacgcttgtggtcgccggacagcaggatgcaggcagaggcagaagaggaaggagctttgagtccccgcagggagccggcatttttatgacgctgatgttaaagccggagttgtcgcccgtgaatgcgccgatgttgacgctggtggcggcgcttgcggtgtgtgcggcgatcgtgaagacgacaggcagaccggcgggcatcaaatggccgaatgacattgtcatgaacgggaaaaaagtctgcggtattctgacggagatgagcgcacagatggattatgtcaaccacattgtgatcggcattggcatcaacgttcacaatgaatcgttcccggaggagattgccccggtggcaacttcactctacatggagaccggagaacattttaaccgcgcggctctgattgaggaagtatgggaacagtttgaacattattatgcaattttcatggagaccgaagatctgagcggtcttgtgaaggagtacgatgcgcatctggtcaaccggaaccagatcgtgaaggtgcttgatccgaaggaaccgtttgagggaaaagcgatgggcatcacgccgcggggcgagctgatcgtggatacctgggagagcagaagactcgtatcggcgggggaggtctccgtccggggcgtctatggatacgtgtagagggtgctgcgcgggcggcgtccgtggaaacggtttggaaaggaatgtctgagatggaagaagtggtactgtgcggtgcgagcgcatacaataaaaaattttacctgaacgaagattttaagggtctgccggagcagatcaagaacgagttgaagatcatgtgcgtgcttttcacggaggatgtgggcggtatttttcagctggtgttcagcgaaacgggcgaactggaattccgcacctcctgcgatgaaaatgatctgctgtacgacgagatcggctgcggacttaagatccgtcagttacagcagacaaaacaggaactgctggaagcgctgcagatgtattataaggttttatacgtgggaatatagggggtacggacgatgataatgacgattgatgtgggaaacacaaatattaccgtgggagtattccggggagacgaggtggtatcgaattttcgtatcacgacgaaaatgccccgtacatccgatgaatacgggatgctgttgagcaacctgctggagcagaattcgatttcacatgacgatattgaggatgcgattatcgcatcggttgttccgaatgtgatgcattcccttgagggggcgattatcaagtattttagcatccggccgattattgtggagccgggaaccaagaccggtatccgtgtcgtgactgagaacccgcgccagatcggtgcggaccgtattgtggatgcagcggcagcgtatgagctgtatggcggaccggtgcttgtccttgattttggcacggcaaccacgtacgatctggtggacaaggacggcgcgtttgtatccggcgttacagctccaggaatccgcatttccgcaaaagcattgtgggaagatgcggcgaagcttccggagattgagatccgcaagccggcgagcatcctcgcgaaggagacgatttcctccatgcaggcagggcttgtctacgggcagatcggacagacggaatacatcatccgtcatatgatcgatgaggcgaacatgggcgaggtcaaggtcgtggcaaccggcggactgggcagaatcattgcaaatgagaccacaatgatcgatgtgtatgacccgaacctgacattgaagggcatgaatctcatctataaaaagcagaaccgtaaatccgggaagattaagtaagtagaaaatgagggtggcagcgtggcaataatccgaacactgcagataggaaatgtaaccttagaaaataatttgatactggcaccaatggcaggcgtaagcgacctgccatttcgcttgctttgcagggaacagggcgcggggctggtgtgcatggaaatggtgagcgccaaggcgattctgtataagaaccgcaacacggaggagcttcttaccattgatccaaaggagcacccggtatcgctgcagcttttcggctccgatccggatattatcagtgagattgcgaagcagattgaggagcggccgtttgacattctggatctgaatatgggttgtccggttccgaaggtcgtcaacaacggggacggctccgcgctcatgaaaaatccgaggcttgccggggagatcatagagaagacggcgcgggcgatcaaaaaaccgctgaccgtgaagatccgcaagggattcgacgatgcgcacgtcaatgcggtcgagctggcgcacattgcgcaggagagcggtgcggcggcggtcgcggtgcacgggcgcaccagagagcagtattatgccggacatgcggactgggatattatccgccaggtgaaggaggcggtatctattcctgtcattggaaatggggatatccgcacaccggaggatgtggcggcgatggcagagcagaccggctgcgacggctatatgatcgcgcgcggagcggagggaaatccctggattttccgtcagattctgcattattttgagacgggggagcacctttcccggccggatttttcagaggtgacggagatgctgctgcgccatgcaaagatgcagatcgactgcaagggagactacacgggcatccgtgagatccgcaagcatgcggcatggtacaccgcggggtaccgcaattcgtccaagcttcgaggaagaatcaacgaggtggagaattacgagcagctcgaggcattattccgggaagtggagtcatataatgagaaaaacggatacgaggcataggaaatgtcctattctaatgagtttcttagaaatttccgaccggtatttctggcgatcttaaaggcgcaaagctttcgcccggagcgcgtggagcttgtggtgattgacgaggagcggagccatgtctttgaaccggcggatgtgcgcgatgtgctcgaacagatcggtgacgatctgaattaccttacggtgtacaccgggcgccccgcatatttttccgcgtttgcagagagaatgtatgaggagaacgggctggtggtgatggtttttcccaaaaccagactgtctgcgtgggaaggacaggcgggggtgagagaaacgtttctgacccggaaggtaatcctggattttgagtgggagggagcataccggacagagatgatctgcgccgcggcgacctacatcccgatccacaaaaagccctggaaacaaggcgaaaatcttgacatcatggtgcctatcggttataatactgtgattgttaagagcatgcatcaccagagagaaaagcttggacgtgaccgatttgaagaagctttttatgaaaattgaactgataaaaattacaaagaagggtagagagtaatggacaagaaaaacattctgacgtatgaaggactcaaaaaactggaggacgaattagaggatttaaaggttgtcaagagaaaggaagtctcccagaagatcaaggaagcaagagagcagggcgatctgtccgagaatgcagagtacgatgcagcgaaggacgagcagagagatattgaggcacgtattgaagagcttgagaagatcctcaagaatgctgaagtatttgtagaggaagaggctgacttagataaggtaagcatcggatgtcaggtaaagatcttagactgtgaattcgacgaggagctgacctacaagatcgtgggttccacagaggcaaacagcttaaagggcaagatttccaatgagtcgccggttggtaaggcgcttcttggaaagaaagtcggcgataccgtaacggtaacgacaccggcaggagagttcgagtacaagatactttccattcacagatcatcaaacgagtagagcatgaccgtctgcggactccgcttcatgcggacaggcggcgcaggataaatggaggaaaagcatggcagagcagaataataaccagcagcaggacgtcaaccagctgctcaaggttcgttatgataagttacacgaactgcaggagaacggaaaggacccgttcgtcattaccaagtatgacgtgacgaatcacagcacggatgtcaaggagcattttgaggagatggaaggcaaggaggtatctcttgccggacgtatgatgttcaaacgtgtcatgggtaaggcatctttctgcaatattcaggacttaaagggacgtatccagatctatgtagcgcgcgacagcatcggcgaggagtcctacgcggatttcaaaaagtatgatgtcggcgatattttaggcgtgaagggtatcgtttttaagacgaaaacaggcgagatttccattcatgcagcagaggtaacactgctttccaagagcttacagattctgccggagaagttccacggactgacggataccgataccagatatcgtcagagatatgtcgatctcatcatgaatgaggatgtgaaggacacatttgtgaagcgttccaaggttatcagcacgatccgacgctatctggacggacagggcttcatggaggttgagaccccgatgctcgtgtcgaatgcgggcggtgcggctgcaagaccgtttgagacacatttcaatgcgttagacgaggacttaaagcttcgtatttctctggagctttacttaaagagactgattgtcggcggcatggagcgtgtctatgagattggtcgcgtattccgtaatgagggtctggacaccagacacaatccggagttcacactcatggagctgtatcaggcatataccgattaccacggcatgatggatctgaccgagaacctttaccgctatgtggcaaaggaagtgaccggttccgagatgctgacctacggggagcataccatggatctctccaagccgtttgagcgcattaccatggtggatgcggtgaagaagtatgcaggcgtcgattttaacgaggtgaaggataccgccgaggcgaagaagcttgcagatgagcatcacatcgagtacgaggagcgtcacgaaaagggcgatatcttaaatcttttcttcgaggagtatgtcgaggagcacctgatccagccgacgttcgtgatggatcatccgatcgagatttctccgctcacgaagaagaagccggagaacccggactatgtagagcgttttgagttcttcatgaacggctgggagatggcaaatgcttactctgagctgaatgatccgattgaccagcgcgcgcgttttgctgcccaggaggaggcttttgcagccggagatgaggaagcgaaccacaccgatgaggatttcttgaatgcactttccatcggtatgccgccgaccggaggtatcggattcggaatcgaccgtatggtcatgatgatgaccaacagcccggcgatccgcgatgtactgctgttcccgacaatgaagtccttagacgctaagaagggcgaagggaaggctgaaaaggcagtagaaaatgctgctgtggcagaggaaaaggttgcagaaaagattgatttctccaacgtaaaaatcgaaccattgtttgaagaaatgattgatttcgatacctttgcaaaggctgatttccgtgcagtaaagattctggaatgtgaagcagtaccgaagtcaaagaagcttttaaagttcactctggatgacggaacagaccggaaacgcacgattttaagcggtattcacgagtattacgagccagaagatctgattggcaagacagcgattgcaatcgtaaatttgcctccgagaaagatgatgggcattgattccgagggtatgctgatttcagcagtacacgaggaagatggacatgagggattaaatcttctcatggtgaatgaccggattccggcaggtgcgaagttgtactaagaatcagaaaatccatagacttttatgagtttatcgagtgtttgacatcaaattgacatcaaatttgtgtcattcggtggactaatatggactgaaaagggatgttttagaaatcagaacctttcaaaacttaatagttgaatgctattaaaaggacattttccaataaaacggagagtgtcctttttctgttgttatggtcaaaacaaaatcaaaataacacaaggagggttctattatgacaagtacagcgttaggagcagaaaccaaaaaggaagaaaagattatttttatcagcgatgcacatgagaaattctactacgagaagttaaaggaagtccggtatcaggatgtttaccacaaggcactctgctattgtcttgggatcagcgatgataccagaagaaatgtttacagaatttatgatttcaaaacaggatgcgtaataacagagtgtttacacgaaggctggcagaccagtggaagtgtgagagtgatcagaatggcattcaatctgtattgcaatggaacaccaagtgtttccgattatgaagatgcagaagaacaggtggacgagtgcaggcagtacacggtggaggaaatattctgctgtgcttatgcaccatatttctggcaggcaattcagattcggtatccggaatatgccacatacaaccataagctgtatgccttattgggaggaacagactaatgttaaaagtcagattgatgggaacaaagaatgatattaagtggttcggaaagattttgcagaggaatccgaaagtggaagtaacggagttttccgagatgtatccgaataagggaacgaagaaattttacagggcgtatgtagaagtaaagaaaagaaacgtagcagaaaaatagcagaaaacaaaggagaatctatcatgtgtaaaataatcgcaatcgcaaaccaaaaaggtggtgtgggcaagaccaccacaaccagtaatttaggcataggattggcaaaacagggcaagaaagtcctgctgattgatgccgatgcacagggcagtctgacagacagtcttggcttcacagagccggacaagctagaggaaacacttgcaacagcacttggcaatatcatcaatgatgaagatatggaagcggattatggtatcctgaaacacaaagagggaattgacctgatgccgggaaacattgagctttccggtctggaagtatcacttgtaaatgtgatgagcagagagcttgtgatgcgttcctacatagagctggtaaaggataattatgattatattctgattgactgtatgccctctctcggcatgattactataaacgcttttgcctgtgcggacagtattctgattccagtgcaggcggcatatcttccggcaaaagggttgcagcagcttattaagaccataggaaaggtcaggagacagattaacccgaagctgatgattgaggggattctgctgacaatggtggatgctcgaaccaattatgcaaaggacattactgcattactggtggagaattacggtagcaaggtgcggatatttgaaaacagtattcccatttccgtccgtgcggcagagatttccgcagagggtgtcagtatctacgaacatgatccgaaaggcaaagtagccgctgcttatcagtctttgacggaggaggtgcttgggaatgagtaaagcaggaagtgccgcaaaggtaaaattaagcagttatgatgatttatttggaaatgcagaagaaaagacagggagcgaagagcagattatcagagccaagctcacggatttgcatgagtttagaaatcatccgttccgtgtactggacgatgaaaaaatggaagaaacaacggaaagcatcagtaagtatggggtgctcgtaccgggaattgcaagaccgagggcagagggtggctatgaaatcatagccggacaccgcagaaaacgaggttcagaacgggcaggaaaagaggatatgcctgtgatagtccgcaattatacagacgatgaagctacgattatcatggtggattccaacattcagcgtgaggacattctgccaagtgagaaggcgaaagcttatgccatgaaatacgaggctatgaagcatcagggcagaaaaggaaacggaaatacgcttgacgaggtaggagaagctgtcggagaaagcggaaagacggtgcaacggtatatctggcttgcaaggctgtccgatgagctgctagagttggttgacagaaagaaaatcggtctggtacagggtgttgacatttcctttctgtcggaagatgcacaacagtgggtgctggtaatccttgaggaaagcggagcaaatatttccacagtacagtctgccaagctgaaggaatatgggaaaagcggcgaactgacgctgccgatggtgcgtctgatactgaccgaggaaaagccgaaagagaggaaagttacaatcaagtctgaaaaaatcagccagtttttttcagaggaatactccagcgaagagattgaggggattatcctgcaattattggaggaatggcagaagaaacagtaaagggggtgcggtaaaatgggtaaacagatacagtttgattattactatgggattgaagcagaacagttttccttttatcgtgttcctcggttgctgattaaagacgagcgtttcaaggggcttagcagcgatgccaagctcctgtacggtctgatgcttgaccgtatgtcactgtctatgaaaaatggctggttggatgaagaaaacagagcctatatcatttatactcttgataatgtcatggaggatttgggatgtgcaaaagcaacctgtgttaagattatgaaagagttggacagtgataatgggataggattgatcgaaaagaaacgcaggggacttggaaaaccggatattatttatgtaaagaattttgccacaataggagaagcagaagaagaaacgcctgcaaatgctgatgtttccacagaagttcaggatttgaacctcaagagttctaaaagttatacttccagaagttcagaaactgaacttcaagaggttcaaaaagcagacttccagaagtctaaaaattttacttcaagaagtacaatatctgaacttgcggaagttcaaaaagcagaccctaattatactaactataatcatactaaccagagtaatattgataggaattatatcaatcctatcaatcaatccggcagtgagttggaaggggagattgatgtgatggaagatgtcaatgcttacatggaaatcatcaaagagaatattgagtacgaacatcacatgaaatatggcagatggcaggacaaagggctgtatgaggaattgtatgaggtaatctgcgagattgtatgtgtgaagcataagactgttaaaatcggtggaaatgattatccatatgagcttgtaaaatcaaagttcctcaaactgaatagctcccatttggaatatgtgataggatgtatgcaggaaacaactacgaaaattgcaaatatcaaggcatatatggtaacagctctttataatgcaccctcaacgatgaatcattattatcagcaggaggtacagcatgatatgtacggaggtggctggaatgaaaagaatattggttaaaattgtgcttccggtatcgttgctggcagtttggatgataacctgttatccgatttgcagaaaagcagaaggatttgattttttcctgtattgggtactggtcggctgtccttatgggatcagaaaaatgtgtatgattctcataccaaaaaatttcggaattgcaggaagtataggaatactggcactgaactgtattgtaggtggtctgattggcagtgtggttgtaattctgagaatggttatggtgctgatggagataataaagataatcagtgatacttctggacacgatgtccaaaggtgcagatgaaaagcgaaaatgaaaaaggcattgttcatcaatcagaacaacacctttaattatcatccgggacgtattccataatctcttcaatccggcagttaagtatctggcaaagcctgtttaaaataagcgtttttacaacaaggttctgccgaagccgctgaagctgtgctttatcaatgccataatctttgataagctggtactggctgattcctttttcctttagcgtacgccaaagcggatcgtatttaatcatactgaaagctcctttccacacttgtattctaagtgcatgaaacatataataatatggtgcgtgtacgcaccataaaacatacaaggagagtaaaaaagttatggaacataatgagtttaaggatcagctatacgaagtattagatgaaaatgatgtggctttagggattgaggatatagatacctctgatgccgcaaatatttttacaataaaaacaagggacggaagtgtttttgaaatagaaacacggaagattgaataagaggcagcacgatgcctcgaaacaggaggtttgcaactgtggagaaaagttacattacagacatagaacgggaacggtgcaaaaaggttgccgcagcctatgcagaactgtatgagctggaaagcattttggtattggatgtaggacggtacggttttgtgaagctgcaatattacacaccggagtatggatttaatgatgttataacctatacagacagtgagagtatgtttgaggacttatggcaggaatggcttgatacccggctctatctcttcgcaaagggaacgccgatgctggaaatgggatatgaggaaatcttcaaatgtctgccggaggaaaaacagaaagagcttttagagcaaaaagcagtatttgcaaaaatggcagaaatagaactgaaataaaacagcgtcagggcagttatgaattgaaagatttgtagctgcccttttttttttgcttttggacacgatgtccagaagcggaaaggagcaaaatggaatcattacgagatgtaaaaagagttatggaacgggagatagagaaagggagctgcccattacagtttgaatatctggaatttggagaaaaaccgtttcagttcatagaatcagaggaaaagctgaatgaggtgctttcgtatttgttgcggttgggggaatatcgaggatatacggagcatcttgtaggaaataacgtgtatatggatttggatatgttgtgccggaaaattcagtttaagcgtacccattcccctgtggagcgtagtgaaatccagtggaaaatacaacgctataaaaataaactgaaaccggactatgcaggtaaggtttgtttagaaatagtgcagtgcgttttcagtctgccggaaggagcagcggagaaggaccagattgtatatgatggacagaaaacctatgcttttgccatgtcaaataagtatattctgggactttttactcattgtgaagccgcaagaaaatctgctgtggaggacggtgtggagtttgtacatctgccggagaatgaacagaaaatcgtcagtcttgaaaatgtgaggaatgtgttgtttcaggcattgctgcttgataatgttacggtggagaatggtctgttccatgcacagatgtgtacggttatgctgttgaaataaatgtaccggaaatatttgatacaggcataaattttgttataatggctttgaacagaatttgtccgaaagagggattgtatgaaaccaaatcatcattcactggcatataaacagcagaaacagccgaataagacctataaggatttaaaacagaagcagaagatgaaaatagcagactggatgtttcgggaaacctgcattttctataaggaaaatggagagataccaaatgaggaggtagcaaagcagattattgaccggatttatgaaaaactgaaatctcttgcaatctgggttccgtatgaagaggtttaccgagcatatcttttaaaattgccacgatatgagcttcgtattgcggaaaatgggataccggaagaaaagccgccgaaggagaaaaaggaggatgtgccgaaaaagaaaaagggaagcagtaataagcggtgtccggtatgcggcaggagaatgaaacagcagtttattggtttgcagcattgcaaatgtggaatgagctggaaaaaggacatcggcttttttgagcgaaccggagatatggtgtttgccttggagcggagaaaaataggaaataaacaaaaacagtgccctgtcattcgatataaggaatagggcatggaaaaacagaaaacagcgtcagggcagttatgagtcgaaagatttgtagctgcccttttttattgcttttggacacgatgtccagaagccggatggaggtcagatgaaatgaaaaagagagaatttcagaaaaaagcagccgcagcgttattgggaaaactggcagatgttgtgatggaactggaagaaaatccaaacatcacaataacgtcggagtatcatagtagctattttaaattgagaaagaattacaatctgattcagatttcggtcaagcagacaggagagctgacgtatcagttgacggatatgctgggaaacacaggcagaagtcagatttatgtacaatatcatgctggagatgatccggaacatttgataaagaagtttgttgaggattttgggcggctttataaggattttcttttagcgggaacgctgcatgattttgttcgtatccagttatctgtggatgcagatacagaggaagcattaagggagtacgaggactgtatcagagcaggctgcctgtaaatcagaatttttggacacgatgtccagaagcggaaaggagagaacatgaaatatttactacatcggctgcttgttccgccctgaaggaacagcagtaaaaaggaaagaaggaggtacagatgcaggaagaagtaacgcagaaaacaatcgcccttgtgattaaggctgcaaagctggatgccaatatcctgaaatctgccatgagaatgtatctgaatcattgcagaaaacaggcacagaaaacgcatgggaaagtgtcggttaaggaactggtgggcgagggtgcaggtgcttcatccattgaaatcacagatggcaatatcaaatcctttgagcgggtagctcgtaaatacaatgttgattttgctgtgaaaaaggataagaccaccgagccaccgaagtatctggtatttttcaagggcagggatgccgatgctgtggcacaggcatttaaggaatttgtttatggaaatgagaaaaagaacagtaggacttctgtaaggcagaaattaaagcatttccgggatgtggtatcaaaggatcagaacaaagaacggagccgggaaaagaataaggacagggggcagagcctatgactaatatcatagcaggcattaccaaagatttaaaagctgtccccaaaaagctgaaggaaaaagcaaaaagtgcagatgttaaaaagctgatactgctgaatcttccctatgtgcttgccgggtacttctgtaataaggcagcatttttatggagagtggcagagggcagtaatgcgtctgacaagatgatggtagtaatgagccaaatggacaggatgttttccaatccgttccccagtttttttctgagtgatttgctgattggaatcgccggaggcgttgccttaaaattcattgtttattataaggcgaagaatgccaagaaattccggcagggtgtggaatacggttctgcacggtgggggaatgccaaagatatagagccatatatggattctgtatttgaaaataatattcttctgaccgctacggagcgtctgatgatgtccggcagaccgaaagaaccgaagtatgcaagaaataaaaatattcttgtgattggcggttccggctccggtaaaacaagatttttcgtgaagccgaacctgatgcagatgcactcgtcctattgcgtcactgacccgaaaggcacaatcttagtggaatgtgggaagatgctgaagcggggcaagtataagattaaagtcctcaacaccataaactttgcaaaatccatgcattataatccatttgcttatctgcggagcgaaaaggacattttgaaactcgtcaacacaatcatagtcaacacaaaaggagaggggcagcaatccggtgaggacttttgggtcaaagcagaaaaactctattatacagcattgattgcatacatctggtacgaagcaccggaggaagaacagaattttgccatgctgattgatatgattgatgcaagtgaagcaagagaggacgatgaaaacttcaaaaatgctgttgatctgctctttgaggagctggaggaaaaagacccgaaccattttgctgtaaggcagtataagaaatataagcttgcggcaggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgatgagttacagggcgagagcaactccatatccaaccaaaaacagatgttagaggattttgcccgccggaatgggctgcccaaccctacgcactttaccgatgatggtatctcaggcacccggtttgaccgccccggatttttggcgatgatggaggaagtggaggcagggcgtgtagaggcaatcgtcatcaaggacatgagccggttggggcgtgactatctgaaggtcggtcaggttatggaggttttgcggcagcgaggcattcgtctaattgccatcaacgacggtgtggacagtctgaaaggcgatgacgattttaccccgttccgcaacattatgaatgaattttacgcccgtgataccagccggaaaatccgctctgtgtttaagtccaaaggcatgagtggcaagcacctgaccggcactgtgatttacggctacttatgggacgaaaaacgggagcattggctggtagatgaggaagccgccgaagtggtacgccgtatattctccctcacgctggagggatatgggccttaccagatcgcctgcaaattatccacagaccggattgaaattcctgtcgtacaccttgcccgcttcaacgagggtgtgaatcgttcaaagccggtcaaagacccctatggatggggatcatctaccatcgtgaacattttgaaaaaacgagagtatttagggcataccatcaatttcaagacccgcaaacactttaaggacaagaaaagccactatgtttctgaggacgaatggacgatctttgagaatacccatgaagccattatcgacaagcagacctttgatttgacgcagaaaatccgcagcaatgtacggcgttatccaaacggctggggcgaagcggctcccctcacaggcttgctctattgtgccgattgtggcggcaagatgtatgtccaccgtaccaacaatggcaggcggatttctcaatatacctgttccaattataccaaagttccgtgtgggacactatgccctacacaacaccgtatcaatgagagtgctgttctgacattggtttctgatacgctccgggctatcgctgaatattccagaaatgaccggacggaatttattcacaccgttcaggaaacgcaggttgctcaacagagtgccgatatatcgaaaaagcgcaggcgtctggctgctgctcaaaagagagccggagaactggaaaaactgatttgcaaaatctatgaggacaatgccctcggcaagctgccggatgcacgatatagggcgcttgatgcacagtatgccaaagagcaggacgcacttgagattgaaattgcggagctggaaaaggctgttaccggctatgagcagagccagaaatccgcagagaaatttatagccctgattgataagtatgagaattttgacactctgacaaacaccatgctcaacgagtttgtagagaaaatccttgtccacgaacgcgcccgaaaaggcagccaggacaccacgcaggaaattgaaatctacttcaattttttagggcgctatatcccaccatccttacagccggttcctttaacaccggaggagcaggaagaactgcagaaaaaagaagaacgtaaggacaggcttcatcagaattatttgaggcggaaagccagcggcgcacagaaacagtatgaggacaaaatcaaggcgaagaaaaaagcggaaatggacgctaagaaagccctgatccgggctgaggatatgaaaaaaggcgttttttctactgtcggacagctgccaaaagaagaaccacgcaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacacctgttagagattgagcggacagcacaggagcgcgtggacaccatgttgcctcacatgatggagactgcgggtgtcacggaagaactgaaagcctgtgaccctatgcgttgggtggggctgatgaacacattaacggcacagattgaggaaattttaatcagggaactgatttgcagctgaatgggaggtgcgggaaatgctgacctttgaaaagattttgaaagtgtttcaggcatatctggatgatgatccactgtatgaggtggttcagaccagccacggttatacattgatggcatgggaaccccaccggaatgactggtacagcgcagaaatacagaaaaccccggaggatttacggaacgctttgttgggtacatacgccaactttctggaagataagattactggaaatgaccgtgacctgactgtgacagaaaccggagaaatccagcagaggtgtcgggaacttttggaaaagtgccgggaaccttgatatagaaatgccagaaggaggccgcgattatgcgtcctccttctgcttcgcagtctgttccattttgagcgccccgtctatggcaccttcgataatcggcaggtattcttcagggcaaagcttcagcttgtggctgacccgttgccgctgttcgctttcttctcgcataatctccgggttaaaataccgttccacgggaagtccgcagaccttaatcaactggatcatcacaggcaggctcggaatcgcaccttgattctcaatgttggcaagataccgccattcaatcccaaccatttctgccaatgtttttcgtgccagacgctttgcctctcgtgcagctttgacatctgcgccgaaggtttcaaaaccgggacaatcttcaactttcgccatataacatcacccagttacattgtataattcatacttcacccgtggaatgttgctatatgcaggttggttgaagtttataattcatatcccgtttcttgcattgttcgaaaaagagaactataatgtactctgtggaggtgcgaaatggactatatgacattgaaagaggccgccgaaaagtggggcgtgacacctcgtagtgcaaattattattgcgctggtgggcgtatctccggcgctgtgaatatggctggtgtttggctgatcccaaaggacgcggaaaagccgactgatagacgcagaaaggagtttcaacatgaataatgttttaattatcgaagatgataaagaaatttgcgttatgataaaagaccatctggaaaagtacaattatcaagtcttcttcacacttactggtgcaaatgcgattgaacgtataaaagaattatccccggatttaattattttagatttaatgcttccttttatcagtggagatgagttaattagaaatatcagaaaattttcagacgtacctgtaattgttgtttctgcaaaaagtttaacattcaacaaagtcgaactgctacgcttgggtgctgatgactatttaacaaagccgtttgatttggacgaattactagcgcgaattgaacgcaatttgctaagaagtcaaaaagatactcccaatctttgtttgacctttggagaactttccattaatacatcttcaaaaatagttactgttgcagacgaaattattgtgcttacagcaaaagagtatcaacttgtagaactactggcgaaatatcctgataaagttttttctaagcaaaatctttatgaaagtatttggcaagaaccatttgcaagggataatgatgtcattaacacacatataagtaacttacgaaaaaaattaaagggcgaaggctgccgaattaagaccatatggggcttgggttaccgatttgcaaagtgagctttagataatctttagctttacctttagattattcaaggaattgtctgcgatactaaataacaagaaaggagctgtgaaaatatgaacgtaacagtttttgaagctatcaacatcacaaaaaagtatcgcaatacactagccctaaatcaagtatctatgtctgtaatgcaaggagatatttatgggtttatcggagaaaacggtgccggtaaaacaacaatgattcgtttactaaccggactggcggaacctactactggcaaaattgctttattcggtgaaagcaataagaaacttgcaaagcagcgtgatcgcattggctgtattattgagagcccttctctttatcttgatatgacagcctatgaaaatttggaggtacaacgtttgcaacgcggtattccaggaaaaggttgcattgataatgctttagcattagttggtttgaaagataccggaaagaaaaaagcaaaagatttctctttgggtatgcggcagagactagctctcgcaatcgctttgcttgggaatcctgaatttctcgtactagatgaaccaattaacggactagaccctactggaattatcgaattaagaaacttactcaaaagactaaataaagaacgtggaatcactattttgatttcaagtcacattctcacggaacttcatcaattagcaaatagatatggtatcttacatgaggggaaacttttacaggaaattaccgctacagagttagacaaacgctgcaaaaagcatttgttgttgcaagtgaatgatgtagctgctgctagtgttttattggaaagcaaactgaatacttcaaattttactgttatgccagacaaaagtattcatctatatgattatgttgaaaatgccggaaaagtatcagcgttgctaagtgcaaataacattacgatttaccagttagcacaatctggagatagtcttgaaacttattacactaatttgataggagggtgccaaaatgattaaccattttaaagctgaattttataaattgcgtcactcaaagatattgataactatattaggcgtatgtgcggcggttataatggtctcttttgcacttggtgacatgactttttttggagccggagatggaacagaaagtgtaatcggatttcaagctaagtgttatctatctagtgaaataccaacgtttcaaactgttgcccgctcatctcttgcatatacagcctttttctggattattggcattttatttgcaaccatattttttacaaaagaatataatacgggtacaatcaaattatctgttgcatacggcactaaacgaactattctctactacaccaaagcgattacaatattggtggtgtctctgataacgtatctgatttttgtagctacatttttcgttattgaaatcatacaatccggttacattccaactgcgagtgaagtaataaaccttttgggatgggctcttgcttgcggaacggttttattagcattagaaagcatttctatttttttatgtgtcgttattcaaaatacagggattgtaacagggatttgctgcttatatgtattcagtggagcgtctgtttacttaatgctatggagtgatatggagacggtttcaatacccttaaaaatttttgtatatggaaatcctatgtactattggatgaatttcagctcttgtcgcacaatgggtattattgagcatttaccattctatttcatagggtgcatttctcttttgattgttggcggtcttattatgattagaaaagaaatcaagtaaaagggaggtagaatatgggttgggcgattatgtttcttgttctgatagcattggtcattatcctttcaatttctttaattaactggaaaatacagatatataaagtaatcgtccaactaaatgctattctgaatagaaaaacgaaaaagttagttacagtgtctttatctgataggcggttagagcatttggttgaaatcataaatcagattgtatcaaaagataatatttatctgggcgaaattcaaaaaaaggagaatgaattaaaagagaatatttcttgcctttctcatgatttacggacaccactaacttccattcgcggatatttgcaacttctatcaagtgcgcctgatgaaaaaagagcggaatatatttcagcattatccggaaaagcattgagattagaacgtctcatagatgacttttatcaaatctctcttttagaagcaggacaatatccattttactatgaaaaggttgagctatgctcattgcttactgaaatcctgctagacaattattcgattttcagcgttaatggaattgaaccccaaatagaaatacctaatatggacatctatcttaatgctgacagaaaggcgtgtattcgcattatacaaaatcttatattcaatgcggtaacatccactacaaataatgttgtaattcaactaattaatattgcagattctgtacaactctgtattaaaaatcctgttgcatctattcctacagaagaatattcaaaactgttggaacgcttttatgtagcagatgtttcaagaagtaatggtacgtctggacaaggactttacattgtgaaaaagctattacttatgatgaattgtacaaatccaataattgaaatacatgaccataattttatgattacgattgatttttcgcccttactcataaaaaaataatctgccggacgacggcaaaagaaaaaaagccgtcgtaaagcagatctattaacgcgcctatgctatcttccggcggctttgaaaaaacagagccgccgtttctttttgcgaaaagcagaaacccgacgacctaacaccgtgtaaatccacggcggcatataggaggattgccgccgtgtctatgcttgccttttttcacggtcccgtcaagatttatgcgcaaaattgtttgcaggctccggctgagtgaagtcagccggcaatagaggcgtcgtccatggtcgcctccaagtgcttcatgttcatgtatttcttgcagccccactgcgtccctgccacgtggcgtagcctcgcgcagaccagcatcagggcggaatttccgtcagggaacgtccccaccacgcgggtcctgcggcggatctcgcggttcagccgctcgatcacattgttggtgcggatgcgcgtccaatgctcgctgggaaagtcacaataggtcagcgtttcctcaatgccgtcctcgaccttcttggcagcctccttcagcttcatggcgcgcagctcggcaacgacggccttcgccttctcgcgggacgcctttttgctctcctgggcgtggatcgccttgagcatttttgccacaattttgaccttggatttgggcacaacggagaaaacgttgcggtagaaatgcaccgtgcagcgctggtatttggcgtccgggaacacctcgcccacggcctccagcatccccatgcacttgtcgccgacgatgagcttcacgccatccaagccgcgtccgcggagccactggaagaagctgacccagctggccttgtcctccttcatgccctctgcggcgcccaaaacctcacgaaaaccgtcctcattcacggcaatcgccaccaaaacagctacattttcgtactctccgccccagttgcggcgcaggtagatgccgtccacgtagacgtatggatagtggccgccctgcaaggggcggttgcgccagtcctcgatgtgaacgtaggctttcttgttcagctcgctgatggtggcgggcgataccttgctgccccacagcgcctccgtgatgtcctccacacggcgcacggaaacgcctgccaggtacatctcgatgagggcctcctccacgctgctctcccggcggcgataccgctcgatgatggccgtctcgaaggatacgcccttgagccggggtacgtggagcgtgacgtcgccggaggtcgtggtgagattgcggtcatagtgaccgctgcggtagccctgacgggcctcactgcgctcatagcgggccgcctgcgtcagcgactccgcctccttttccaacagctcgtttagggtttcctccacgctgccgcgaaccaattccttgatttgccccttgataatttcctcattcagctgtacaattttctcggacatagtttgctgtctcctttcgaatgtttgtgtggtaacttcattctaccagagcctgcaagctatgtcttcttttttgctcttttcaatttgcgcaacttattgtaccttatctttttcacagtacccatgacctgcaccagctaaaaaaagtctgttcccagcagcggagcaatgcggtcagaagtatgcactataccatgtaactaaacagcaaaatatactctattacgctcgtatggctttatgccgtccgggcgcttttttgtccctgtggagccggaacatcgggtcagcatggctcgaactttatccccggtgccgctccccgccgccccattcagatttacccaaaaaatctgaatggaggaaaggcagatggaagttaccatcaattataacggacaagctgtggccgtggaggttacgctggaagtctatgaatttcttgaccgggccgatcataaaacggagaacctgttccatgaacagcggcggcattgggatggccgggagtttgacgagtacatcattaccaccgagggcgtagggggctacggcgaaacgccggaggaatacctttgccgcatggaaacgctgcatgagctgatggctgttctggacacctgtaccgaggcccagcgccgccggttcctgctctatgcgcttgacgggctgagccttgcagagatcggtgtgctgtgcggctgctccaaagtggctgtttatcaaagtgtggaagcggtcagaaaaaaatttataaatttctttgagaacaggcttaacgaatgacctgttttctggctaccaagtgaaagggatcatttcccttatctcagcgaggggcggacagcggacgagctgcccgcctctccaattttcaggaggtaagcctatgaaaacaatcaatctgcggtggatgtatccccactaccggcatgacgagtttgtggatgttacggacaaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgattgcagctctgcctgcggctctggctcatgccactccgacacaggcccgccgtgttcacgcctactacattgccggtatcaagcagccggaaatcgcccggagagagggtatccatagcagtaaggtcagcgttgccatccaccgggggctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggataagagggccgaggccgccagagatcgcaagatgttccggtataaggcgttttattcccttgattgtaacgatggaatcgaaaatgccgccatcggctgggcgcagccatcgccggaggactacctgatagaaaaagaagaattagccgaatacgaagaactgatacggcgattgtacgaagccatttcttccctgccgcctatgcaggctcgccgtgtccacgcccgctatatgctgggtatgaaagtgaaagatattgccgcaatggagggtatcacaccatcacaggcgggaaaatccatccacgctgcactgcggaggctgcgccggtactttgcgcgtcagaaatggacggtcaatctatgagtatttccaaagaaaagaggtgcctgacatgaacgaaaaaattacagcccacccccaaaaagaagaacgggagaaagtcctgaaggagatccggcagcttgaaaaccgcaagaagattttagagaacaagcagcggaatgaagaacgcaggggtcgtacccgccgcctgattgagcgcggagccgttttggaggggattttcccgctggctcccgacctttccggcgcggaggtcaaaacatttctgattgccctgtcccatcttccgggggctgcggaattgactgcaaacctgccaaaatccggggacacgccataagtcccttgtttacaagggcacgccataagtcccttgtttacaagggcgcacttatacaccgttgccggtgctgtgcgccctgccgggggcattgcgtacttcgtccgcgatgggaagctacgctccccaaaccccttgtgcgctctgcacagccaaacacccgctttgcgtttgtccggctccacagagcctgttatgccctcactgaaaggaggtgttccccatagatttctgtcatatccccgtcagtatcatcaagcgcagcgcaggccgttctgctgttgccgcagctgcttaccgcagcggaaccaagctgacaaatgaatgggatggaatgacccacgactacacccggaaaggcggcattgtccatgcggagatcatactgcctgcccacgccccgccggaatttgcagaccgatctatcctctggaacagcgtggagcaaatcgagaaagcaagggacagccagcttgcccgcgagattgaagcagccctgccccgtgaactgtccggcgaacaacagctcgcccttgtgcgtgcctatgtgaaggacaactttgtagacaaaggaatgtgtgccgactttgctatccatgataagggaaccggcaacccccatgttcatatcatgctgaccgtccggcccctgaaagaaaatggcgcatggggcgcaaagtgccgcaaggcatacgacctggacgaaaacggccagcgtatcccggacgggaaaggcggctggaagaaccaccgggaggacaccaccgactggaacgacaaagggaatgtggagatttggcgggcggcatgggcggcctgcaccaaccgggcgttggaatctgccggcagaccggagcgcattgaccatcgcagctacaggaggcagggcattgataaaatcccctctgtccatctggggccagctgccagccaaatggaaaagcgcggcatccgcaccgacaagggagaagtaaaccggcagatcgccgccgacaacaagctgctgaaagaaatcaaagcccgcattacccgtctttatcgctggtcgaaagccgaaacggaaaaaccacaaacacagcaaagcagcttgaccgccttgtgggaggcccagcagcagttggacgctccccgcacccgcaccggcaaaatccgggctttgcaagaaagcgctgcactattcagctttttgcaggcaaacggcatccagtctatgcagcagcttcatgaaaaaatcactgatatgaacagccgttactatgacctgcgcggaaagatcgtcaaggccgagcgccggatcactacccttaccgagcgcagggagatgtgggaacagtacaaccagtacaagtccatccacaagcagcttgccaaagtaaagccggaaaagcgggaacagtttgagcagcgccacagccgggaactgattctgtatgacgcagcgacccggtatctgaaagacttgaaagacaacggcgaggcaatcaccccgaagacatggcagctggaaattgaccagctggccgctggaaagcagacggacacgcttgccatgaaatccatgcgggaggatttgaaagcagtggaacggctccgcaaaaccgccgagcagctgtccagacaggaacgggacaagtctcacgaccgggagccggagcggtaagggctaccgcgtttcacgacatacttttgcacacagaaaaaccgccgtacaggtttccccatacggcggcagactgtttatttgccgaacaagtcgctgtgtgtgccggtgcgggccagcgtcagcaccagaacatcctcttctatgcggtagacaagcagccagtccgggagaatatgacattctcgatggcctgcccaatcgccggacaaatcgtgatcgcggtttttatccggcagcggttcgcccatcgacagcagcgccacgacctgttccagcaattcgattttcaggccgcgcttgattgcccgcttgtagtcctttttgaaagcggtcgtgtacttgacggtgtactttgttttcctcattttttcaggtcggcaaacaactcgtcaaggtcattgtatccctttacagacgggtcttttgcaatcctttccgcttccagcatggcagcaatcgtttccttgttcggctgttccagccttacttcaaagggaatgccgccttcacgaagcgactggcgcacaaagatgttaaacgccgtagtcaggttcatgccaagctcagtaaacagtgcgtccgcctgcgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttaccggctttatgaaagaaatcatttatgaagaacaataagtctgaacctatcccagtcatggattaccgccagtaccgcagagtgcggaggctggtgcatgagtgctgtaactacatcgacggaaactgtatcgccctggacgatggggagaaatgtgtctgtgtccagtccatttcctattccctgttgtgcaggtggtttcgggcggcggtattgccgcaggataaggaactggaaacggcgctgttccaccggctgaatgctaagaaatgctccgtatgtggggcgctgtttacccccggttccaaccgagccaaatactgcccggaatgtgccgcacgcatgaagcggatcaatgccgcaaagcgcaagcggaaacaacgggagaaatgtcacgctttaggggctgaaaaacctttgtaaatcaaggcttttttcgagggtgtcaaaggcaggctgatagatttatcctctgacccataaaacggccttaaaatgcgtgcagaatcccaagagaaaccccaaggaggaaccctatgtcagacaaccgaaaatattattacctgaaactcaaagaaaactattttgacgatgattccatcgtgctgctggaaagtatgcaggatggtgtgctgtattccaacattctgctcaagctgtatctgaaatcgctgaaacatggcggacggcttcaacttgacgaggacattccttacacggcgcagatgatcgccaccattacccgccagcagatcggcactgtggagagagccttgcagatctttttgaagctgggtcttgtggaggtgctggacagcggcacattctacatgagcaacatcgaacttttaatcggccagtcctctaccgaggccgagcgaaagcgtgcggcgaggctccaaaacaaggctctttccgcgccccggacaaacggcggacatttgtccgacattcgtccaccagagatagagatagagttagagaaagagatagagataaagagagagatagagaagggacgctccgcccgcgcctatggccgttaccagaatgttttcctgacggacgaggaactggcagacttgcaggccagttttcccactgtatggggccagtacatcgaaaagctgtccgaatacatggcctctaccggtaagcggtatcagagccatgccgccaccatccggcgctgggccggtgaggacgcgaaaaaggcggccccgcccacccgcaaccgtgattacagcgtaaaggaggatgaaaccgtatgatggagattaccgcagaaatccgggcgctgatcgacaaggcagccgccggtatggaactggccggggacgagtacatagacccggcagacggcctcattcactgtaaaaagtgcggcggccagaggcagaccgttgtgccatgctttgggaaacccggctacttcatgccccgctgtatctgccagtgtcagcgggaggccgaggaacagcgcaaggccgccgaggaacggcagcgccgcatggagcgcatcaagcgccggaaggcccagggcctgcaagaccgctatctgtacgactacacctttgccaacgacaacggccaaaatcctctgatggacaaggcccgcgcctacgtggagaactggaaggaggcatacaggaacaacaccggcctgcttctgtttggggatgtgggaactggcaagtcctttttcgccggttgtatcgccaatgccctgcttgaccgggatgtgccggtgctgatgacgaactttcccaccatcctgaaccgtctgacgggaatgttttccgaggacagggccgactttatcgccagctttgacgagtacgacctgcttatcattgacgatttgggtgtggagcgcagtaccgagtatgcgatggagcagatgtttttcgtcatcgacagccgctaccgcagccgcaggcccatgattatcacaacaaacttgaaactgtccgagctgaaaaacccgcctgatctggcccacgcccgtatctatgaccgtattctggaacggtgtgcgccgattctttttgacgggaagaatttcagggaagaaaatgccggtgctacccgacaggcagcaaaagacattgtaaacagtaagcaagactgattttttactgggcggcacagacccgcccggagaaaggagcgccatgaacaaagaaccccgtactatgcaggtggcagacgccgctactgcgtccagagcgccggaaaacacgccggcgatggtaaagaaaatcggcaagacgacctacaaggttcatgtccatttcagcaataccagcacagaaaccatgagcgataaaatcaagcgtatgctcaaaaatgaaattcagcagatgtgacagactgataaacgaagccgccttgtgctaaactgatgatggtacgcaccaaaatttttgtcaaggaggacacgaaaatgctttacacagaaaaagagaaacatgaaattgagcgagtaaaggaagtctttgcggaacatctgcggcaaagccctgattttgaactgctctggtcggacaaggtgggctatgtctggctgacgattggcgtaaatcctgtctatgtggataccggtatcaggatagaatctgccgctgatctctgctgcaagtgtttggatgatgttgctatggatgttttgtatatgacgggcaacgatcatgcactggaggaagccgatccgctggaattggccgaaatcaagcggcgctgggagccatatatcaaccagctgccagactatgcgtatctctgcaaagacctgctggacggaaaaatgtaagctgttaaacgaggtgtcaggagccatacggtgcttctggcaccttttttgtgaatttgattaaaaagtccttgacaatttgtctctggaaaaacagcgaagtcgattctgattagctgcggtgcgaggttagcaccatttgatataaaagagctgcgtgacctgatggaatatgatgaactggagcttgacacgctgggagaggaaaaaacagcgttgttcgttattatttctgatacagatgctacgtttaactttgtggtgtctatcatgtattcccagctctttaatttgctttgcgacaaggcagacgatgtttataacggaaggctcccggttcatgtgcgtatgctccttgatgagtttgcgaacatcgggcagattccacagtttgagaagctgattgctacgatccgaagcagggaaatatcagcttctattattttgcagtcaaaatcacagctcaaagcgatttacagggacaatgccgataccatagagggcaactgcgacactacgctgtttctcggaggaaaggaaaagaccaccctaaaggaattagcagaggtattggggaaagaaaccattgacctgtacaacacctcggatacgagggggacgagccagtcctacggtctgaattaccaaaagaccggaaaggaactgatgagccaagatgagattgctgtcatggatggcgggaaatgtattatgcagcttagaggtgtcagaccatttttctcggataaattcgatataacgaagcacaagcggtacaaagagctgtccgattatgacaagaaaaatgcctttgatatggaacagtatgtgaaacatctgcaccacttgaaggtcacagaaaagacaaaggtagatgaagcctttgaatgcggggagatttccccggatacaactgaataggaacatttggacacgatgtccagaggtacaggagttttgcggatagaaagcaatgctccttattttttgcaaaaaataaattttcggaaagaacgaggtaactgaatatggcattttttacatcagcagtaacaggattaaagaccgttgtaaccgcaatcggagcaggcgtggcagtatggggcgttatcaatcttcttgagggatacggaaatgataacccaggggcaaaatcacaaggggtcaagcagctcatggctaattagatgtaataaaagcggagaaaggaaaagcacaatccagacggaaccggcggtgtagtcaagaaatattgtggaaacgcaagatttctgctataatgggtataaaacacttgacgatggaaagaaaggcgggaagcctatgcacattagttatcagccactatggaacacactgaaagagcgtggcatgaggaaagaggatttgcggcttgccgccggtcttaccacaaatatgattgccaacatgggcaagggaaagaatatcagcatggaaacgctggttcgcatttgtgaagccttgaattgtggtattatgaatgtgattaaattagaacaggacaatatctaaagcgatataattttatatttgattcgatttgcacaaaaaattaaattttaattgtgtatattttctattgtacccaatgtaaataagtgctatcataaaataaaacaagtacatttgaaacattttatgatttgagagtgtgcttgcaggttagtagcatattgccaataactgaatacaaaaaatgtaggttctggtcattttagaaaggagcattgtttatgaaaaaatttagtaaaagattgtttacctcgttggtagcgttttgtatgcttttttctgtgagtgcggttcctgcttttgcagcggaaacaacaacggaaataacggatactcaacagccggtagtcattggagaatatgacggatacttaaccgatgttatgatttccgatggtgtcaccaaaagagcagtcgctaatgttcgtattaactcttatgcaacttatgatgaggatgatgggattcaagttcatgtgaagttgtatgtaccgtggtatgaatctccaaaaccggagttcactggtatgactggtacagttaatgtgcttatgaacaaaaaatccaccaatacggcatttgcagaattagccgacggtgaagaaacaatcgaaactgatgtggatactggaagaacaggtaatagcggagataagggaacggtttctgtttctggtgttgctaccgctaataatgccttggcaggcggtggagctttcgctatttcttaccctgtgacacttccctaattaaatgcaaaacagttgtgaattaaggttggtaataggtaaaatgaaacggttattggcaatatgcgtatgtttttttatgtgtgtaggcttatgttcgtgtgattcttcccaaactcggtcggtatcatcatataactggtctttagaatttattactgatttagatggtaatatgttattctcaggttcagtgcatgatgacataccagtattggatttgacattgagttttgaagaaaaaagttttatcttaacagataacactcataaacaagaatggacaggtacatattcgcttgaaaagattgacaattcttcttcgaaactcggattaacttttgaaaatttagaggagcctgttacaggcgtatatggaacaagagtttattctgatgattcagaaagcgcaacaattacattacaaactgatgaaaatatcctgtcttttgttggagaagattcataaataaaaacagccgctgtaggaacaaaatcctacaacggctgtttttatttccacggcctgcgccggaagttcataccagactgttttatcagcggggatttcttgaacagctttttcaaaaggcttcgttcctcttgtgagagccgcttgtatttgagccggaacgccttgcagaatatctccgtgaattgctgaaccctgtcccccggagattgcatggccttttgtacttcccgtataagttcatcggcaggcgtggtatccggcgcactttcgctgtcattttcgtgcgccttgcgtatatcatggagaatgacgtcccatgttttgtgcgtcacatggcagaaaaaatcttcttcctctatctgacaggcttccaacactttgattgcccggtctgccgcagcttcggggtgttcttccagtaccatagcccgtaaagcagccagtgagctgtttgtgtcatggaagtgcatggttgctatcccgtccacatagatttctgcgtctgccagcaattccttaaatttttcatgggagataatctcacacagcagccggttattgaagcgttcacttttcagcagttccacgacttcatcactcaaatgtaattcttctatcggggtgttttcatatctccgattattggtaaggccgagcagatagtcaaccgacacctgatagaagtctgccagcttcaacaggctgccgtggttaatttccttgtattcgtcgttgtcgttttcataactgccgagggctgattttgaaatgccggtttcctgtgccagttcttccagattcaagccccgttccacccgtaaatctttcaggcgttcctgtacggaaatgcgggttttcataaacacatcgctccttcctgcggctggctgccgctgttattccttattataccatataccgttccgaaatcgtggaatttttcgattttggggcggttttcctattttatggacatacgggaaagggttcaaaaatgagctatgattaagtcagttcatcgatggattatttccaatcgaatgaccggcctgatgggatatgctccccggcgatgtagcgcaacgacctgcggcaaggaaatggaggaaccttgaccgcagcgagcgtaccaacgggaacgaaacgccgctgtgagattcaggggcaggaacgacagcaggacaacccggcagaactgataccaaaacgctacccaaacacgacaaatcggcggggtgtagtctgccccgtccgtaatactatggggcatttcaaagcggctctatggccgtattttccttgaaaatcgccccgaaacatgacaccaaaaacctttatccgcctgttcccgttgttacggctgaaatgggcggattttctatgataggaggcactatgccgagaatgagcaagaaacggaagttggagctttccttcttcctcaatgaccgggggcgtgtggcctacaacgacctgtgccggaagtgccagcataagtgcaagcagagtttccgggctgtcgtgatagactgcccccattacctgtcaaaacgagccaagcgaaaggagaaaatcagttaaatggaatttgaatttatgagcgcagacacggttctgccgccttgtatgccgctacccgccgcaatgcttcggctgccgatcagcagcacagcaaaagtcatgtatgcccgtctgctgaacaccacccttacggcagggatagaggatagcaacggcattttgtttgtccgttttcctatcatggaattagcggcagccctctcccgcagccccgtcactgtgaagcgttccctgaaagaattggaggacatcgggcttatcctgcgggtgcgccggggtgtgggagaaccaaaccgcatttacacgctgcttcccaaaggagggctgccatgataaatgagaagctggaaaagctgaatcaggagattgccaaaggcgaagccagactgcggcgggcgcagcatgaagaaaaaatactggaacaccaggtgaagcagcttacccggaaggaacggacgcaccggctctgtaccagaggagctatgctggaaagtttccttttaaggccggaagtgctgacagacgaggatgtgatggacattctgaaacaggcattttctcaaagtggcatgaaggaaatagttgcagaaagcgtgaaagggcgggtagccggggaatcccttacggagtaagggcgcaactatacaccggtcaagccggtgcgttgcgccctgccgggggcttcctgcggaaagcggatgattttcagcaccgttgcggctgcttccaatcatcacaggggacgctacacttcccctgcgctggctgcgccagctacccctttgtggacttgccgcccgggaacaccttgcgctgcaagctgttcccgtccagcaagtttacaatttatctattccaaaacaggactgcccgtagtataataaagctaatgacgaacactatctaaggagatggttttatgtatggattgattgctttgaatttcatcataccctttgttatggtttttgtaggatatatcttaaagaagcacccggtaaaagatatgacatccggtaacggatacaatacgcctacatctcggaagtcacaagagcattgggattatgcacaaagcatagcacctaatatttttattggtattggcaaaacattaggtttggtagaaatcgttttgtgtatatccttacttcttcttaatatttctacacagactaccgtatttgcaggagtagttgttggaattatttttctgatttttggattttataaaacagaaactggaattacaagtaaatttgcgaacaaaaacttttaagctattagacagctttccatcatcgagccaacctgacccgaaccttcaaaactgaatactaatcgcctaccagcgacaccactaagcaggaaatcagaaacggtttcctgcttttcttttgcccaaaatcaaccacaggaaggaggaacgctatgccctgtccacaccatgatataaaaataatccagcgcagcaaccaccagtcagccgttgcgtctgccgcctaccagagtggggaacggctgttttccgagtacgaccagaagcagaaatactattcccataaaagcgagattgtccatacagaaatcatgctgccgccccacgccccaccagcgtatgcagaccgcaatactttgtggaacgccgccgaagctatcgagaagcaatggaactcccagcttgcccggagaatcgtgcttgccataccgagggaaatccccccggaacagcacgccgaccttatccgggactactgccgggagttttttgtttctaaaggcatgattgccgattttgccatccacgacaaagggaatgggaatccccacgcccacatcctgctgaccatgcgggcaatggacgaaaacgggaaatggcttcccaagagccggaaggtttatgaccttgacgagaacggcgagcgtatccggctcccgtccgggagctggaaaagccacaaggaggataccgtggactggaacgaccagaagtacggagagatctggcggcagggctgggcggctaccgctaaccgctatctggaagccaacggacgcccggagcgccttgaccttcgttcctatgaacggcaggggcttgataaaatccccaccgtccatatggggccagcagtcagccagatggagaaacgagggatacagaccaacatcggcaacttgaaccgggacatcaaagccgccaattcccttatgcaatctatccggcagatggtacgccacctgaaaggctggattgcagacctgaaggagaaaaaagccgccctgctggaagccttgcaggaatcgaaggaacccaccctgccggagctgctggggaaatatctggatttgcgccgggaggaacgtacaggctggacaagcaaaggccagcttacaggcagcgttgccgatttcaacaaggttatggaagctatccgctatctgcgggaaaaggagctgtccactgtgcagagtttggacgcttatctggataccgtcagcgggcaggccgtttccatccgggcagagatgaagccgaaagaacagcgtatgaaagaaatcaacaccctgctttcccatatcgccaactttgaagcccataagccggttcatgtggagtatgctgccatccggtttaagaagccacgggaacagtttgccgccgcccatcgggacgagctggacgcctataatgccgctatccgttatttcaaggtgcatttgaaggagaagaagtacagcattaaaaagctgaatgaggaacagacacagcttgccggagaagttgccggatataaggaacggttgtccgcattacaggaggatgtgaagattctccgggatgtgcgtcactggctcaatcaggttcttccgtctgaacagtaccgccagaccgccgagccgggaaagaaaccgtccatccagcaggcagtcaaaggccggacgcagcgtatccgggaagaacaggccgagaaacggaagcagccccgcacagagaaaaaacaggatatggaactttaataggcgcttgctattttctttttcgagaatgacaggcgcttttcttattttcaggaggatttatttgaatgtatttaaagctgtcaagcagtctgttaccacccggcaggctgcggagcattttggaatccgggtgggacgaaacgggatgtgtgtctgccccttccatgctgataaaaaccccagcatgaaggttgaccggcgctttcactgtttcggctgtcaggcagacggggatgtgattgactttgtttcccgtctggaagctgtcagtccgaaggaagccgccctcatgctggcgcaggagttctccatcccctatgaggacagggaaccacccggcaggagaaaacccaaaccccggcaggaaaccccggaacagcggttttgccgcatggagcgttactgcttccgggtgctgtccgattattaccatcttctgcgccgctggaaacgggactatgcccctaagatgccggaagaagcatggcacccgctttttgtggaagccttgcagaagcaatcccatgtggaatatctgctggatgtgctgctctccccggatatggaggaacgggcagtccttatcgttgactatggaaaggaagtgagcaatcttgaaagacgaatggcagagcttgccgcccaagatacggcaggccgcagaacagaccatacaagaagcagccccgccccggagcattgaggaagtaaaggccatgctggaaagcaccgagaaaggcagcgtccgcaacagtatccgcaactgcctgaccgtctttcagaatgacccgctgctttccggggcaatcgcaaaaaatctgctgaccgagcgagtggacattgtaaagcccatcggctaccaccgcatcggcaccgccatcacggacacggatatgaactatctgctcctgtatctggaagaaacctatgggcttaccagtgagaaaaagattaccgccgccatcgggattgttgccaatgaaaacggctaccaccccgtccgggactacctgaacggcctttcatgggatgggcaggagcgtatccgctattgcctgcgccactttctgggagccgacaccgaccagtacacctatgaagccctgcggctgttcctgctgggagccatccaccgggcattttgccccggctgtaaatttgaagtcatgctctgtctggtgggcggtcagggagccgggaaatccacctttttccggctgctggcagtaaaagacgagtggttttccgatgatttgcggaagctggatgatgataacgtgtaccgcaagctgcaaggccactggattatcgagatgtcggagatgattgccaccgccaatgccaagagcattgaggaaatcaagtcatttttaagccgacagaaggaggtctataaaatcccatacgaaacccacccggaggacaggctgcggcaatgtgtgttcggcggcacttccaatgcccttgacttcctgccccttgaccgttccggcaaccggcgcttcctgccggtcatggtgtacccggaacaggccgaggttcacattttggaggacgaagccgcttccagagcctatcttgcacaggtctgggcagaagccatgacggtttaccgcagcggggattttaagctgtctttcagcccggaaatggtgcgctatctcaaagaacaccagcgggatttcatgccggaggacaccaaggccgggatgatacaggcataccttgaccgctataccggcggcatggtgtgttccaagcagcttttcaaggaagccctgaaccacccctttgacgagccgaagcaatgggaaatccgggaagtcaacgacatcatgaaccattgcgtgacgggctggaattacttttccaacccccgtgtgttcccggaatacggcaggcaaaagggctgggagcgtgaaacgaaagcaacggacatcagcaacggagctgaaaaaatcccggaaggatttgaggaagtcacggaacagatggagcttcccttctgaaaaatgcagccggttgccgaccctgttgcactcccgttgccgagccggttgccgggaaccccccgtaactgcgggcttttccccttatcagcaaccaaaacaacagaaaaataaaagaaaataaaaataagagccaaactgccagacagagatagttttcaggttttttgaagcccgttgccggacttcgttgccgaccttctccttgtctggcttattctattatggaggataactgcctatggcaaaaacgaaaacagagattcatgttaccacagtttttgacggcgaactggacgccacagacgtctttgtgagcctgattgcccaaaaatatgggcagaataccagcaaagaaaatcttgcgaaaacacaagatttagagtataataaggatgaggttcagaagaaccgtgttccgtctggattgtgcgggtaaacggttatgatgaacggatatgaatatacagacatggacgcaatactggcaggcagcttccgggcagccatctattgcaggctttccaaagacgatgaccttgacggggagagcgccagtattgccaaccagcgggatatgctggaaaaatactgcgaaaagcagggatgggaggttgtggcagtctatcaggacgatggctacacggggctgaacatggagcgccccgacctgaaacggatgctcaaagccatcgagcgcaggcagataaaccttgtcataacgaaagatttatcgaggttgggcagaaattatttgcagaccggcacactcattgaggacttctttccccgccacggcgtccgctatatcgccatgaatgacggtatcgacaccatgcgggagaataacgacattgcgccgttcaagaacatcctcaacgagatgtacagcaaggatatttccaagaaggtacattcctcttaccttctgaaagcccagcaaggccagtttaccggctgtatcgcccctttcgggtatcagaaagacccggaggacaaaaaccatctgctggtggacgaggaaaccgcccccattgtccggcaaatcttccgctgggcgctggaaggacacggcccgaactttatccggcgcaggctggaagaacagaaggtgccttgccctacatggtggaaccgggaacggggcttccgcaatgtccgcactaaatgggaaaagaaagacccggtaaacgggcggtatatgtgggatttttcggtaatcaaggacatcctgatgaatcccgtctataccggggctatcgcttcccagaagaaggactaccgcttcaaaatcggcaccatcggggaaaaaaagccgcaggactggattgtggtggaggaacggcatgagccgattgttgaccgcaagagctttgacatcgtgcaggacaagctgaaatcccggcagcgttcccgccagaccggggaaatcagcctgtttgcggggcttctcaaatgtggcgagtgtgggaaatcactgactatccgctacaccaacgacaagcacccgaagcagatttattcctgtaagacctataatgcctatgggaaacagcactgtacccagcaccgtgtggagtacgaaaccctttaccgccttgtgctgaacaaaatccgggaatgtgcgaaggccgccctgatggacggggaagctgttgccggacggcttaccaacacctgtgaagccgagcagaaaggccagcgggaagcgttggagcgttccctgacgaagcacgaggaacggattgaggtactggaaaaaatggtgctgcggctctatgaggacatggttgccggacgtatcagcgaagcaaacttcaatctcatgctggataagacgcagaaggaacaggctgaactaaaggaacgggttgaacaggggcgcaggaagctggctgatgaaatccgccttgccgtggacgccaagcaatgggtggacgccattcaggaatacgccgacatcacggagctggacgctgccaccctcaaccgtctgattaaagaaatcgttgtccatgaacacatcgacagcgataagacacgacacatttctattgaaattcattttaatctcaaacccatcccggaggtggaacaggtcacggcctgacctgttcccgccggggcggttctaaaaaaattccataaatttcttgacacgccgccgcccgccatcgagcagagttttacacctattttggtatgaaacagctcatggcgggtggcggtattgtaattgtggcacagacggtaattccgcagcttacaagcctgttttcctaagtcatgggagcgattctcgacaagataactgaatttataaaggaaatactgcaagggtgggtcatggacaaccttactacgatgtttacagatgtgaatgataaggtcggaacaatcgcaggggaagtcggcaggacacccagttcatggaacagcggagtgttttctatgatagagaacctttcggaaaatgtgatgatacccatagcgggcatgatcatcagtgcgatactctgctatgagctgattacaatggtcatggataagaacaatatgcatgaagtaggaagcgagttctttttccgttaccttatcaaagcctgtatcgctgtgctgcttctcagctacacctttgacatcacaatggcgatttttgatgtgggaaaccatatcgtgaccagagcaggcggtattgtttcgggttccactaccattgatgtgacggataccctaaaaaccatgtttgacagtcagattgatacaatgggcatcggcgagctgatcgggcttggtatcgaaactatgattgtcagcttatgtatgaaaatcatctccctgcttattaccgtcatgcttttcgggagaatgattgaaatctacctttatatttcagtagctccggttccctttgccacattcagtaaccgggaatggggcggtatcggcaacaattatatcaagggactgtgttcactggcgtttcagggatttttcattatggtatgcgtggcaatctatgcggtgctggtatccggcattgcggttgcggacaatctgcacacagcactgtggtcggtggcagcttataccgttgttctgtgtttcagcctgttcaagacaggttcccttgcgaaatcaatctggaatgctcattagaacacatttcaaagaaaggagggaacagccggggcttgcagtatcagctccggctgtgatgttatggcaatatccgtagcagtgccaaagaatttaagcggcataaagacaaaagtagcgttaaatctgacgaaacgccagcttatttgcttcagcggtgcaggtgcggtagggattcccttttacatttttacaaaagggtttatcggcacacaggcatcggcacttttgatggtagcggtcatgctgccttttttctttctggcaatgtatgagaaggacggatttccggcagagaagattctgtattttatgataaggcagaaattcctcacaccggggattcgtccctacaaatcagaaaatatttacagaagattagaagaaacagagcgtataaaagaggaggtgcgtaaacttgaagaaaaagcaggcggcagaaaagccggacagacataagaaaaaaggaaaaacgaagccggggctgacctttgtggagcggagaaggcttgcggagttaaaacacatgcttgccggaacgaataaaaacgcagaaaagcccaccacagcacagaagaccattacctttcagaagatgtaccgggacggtatctgtcaggtcacttctggcttttatacgaaaatggtggagttttacgatataaattatgacctgctggaaatcgaggataagggggaaatactggaggaatacagcaggcttatcaattattttgacccgtctattaaatttgagctgttcctgttcaaccgacaggttaacgagcagaccttaattgaccagtttgacattccattgcaggcagatgattttgatgatattcgtgaggaatacacgcagatgttaaagaaacaggctgcaaagggaaataacggtattatcaaatcaaagtatctgatttttggaattgagagtaaaggctttaaggaggcaagggcaaaacttgtcagcattgaagcagatgtgattaaaaatttgactaatctgggcacacacgctaagagccttgacggaaaggaacgtctgcgtatcctgcatgagtattttaaccaggatactatggagcctttccgtttttcttttaaggaactggcggagtcgggaaaaagtgtgaaagattacatcgctccgccgggatttgattttcgctatccgagtcgttttaaggcgggaaaaatgtatggcagtgtgcattatctggatattattgccccgaagtttgatgatgagttgttgaaaaagcttcttgatctggatgcgaacctgactattaccatgcatatgcagacaatggatccggtcaaggcgattaagatgctaaaaggtgctttgacgaatattcagaagatgaagattgaagagcagaaaaaggcggtaaggtcaggttatgacatggacattcttccaacggacattatcacttatgaaaaagatacccttgaccttttggacgatttaaacagcagcaatcagaaaatggtaaagatgacatttcttctgacctgctatggcagaaacaagcgggaactggaaaatatcacgcagagggtatccggcattatccaacaggcgaactgcaacctcagatgtatgcagtatttacaggagcagggactgatggcatcggcaccaatcgggtgcaacgatacgggaattgaacgggatttgacaacaaagagtaccgctatcttagtaccgttctgtacgcaggaattatttatgccagctccggctatttattatggtttaaatgccctttccaacaacatgattatggcagaccggaaacggcttcgtacaccaaacggtgtgattcttggtacaccgggaagtggtaagtcttttagtgcaaagcgtgagattctttcctgtttcctgatgacaaaggacgatattgtggtctgcgatccggagggcgagtattttgcccttgtgggagcattgcacggacaggtggtaaggctggcaaccaattccaaagattatttaaatccgatggacattcagctttcccataaaggggataaggaagccttaaagctgaaatccgattttatcattactctgtgtgacttgattgccggaggaaagaacggtctggaaaatgatgagaaaggtatcattgacgaatgtatccgtcatatttacgatgcttattttgaaaatcccgtaccggagaatatgcctatccttgaggatttgtataatgccctgttagagcataagaacaaaaaggcagaacggattgcaaactcccttgtgctatatgtgcatggttcgcagaattattttaaccacaggacgaatgtagacagtcagaaccgtatcatgtgctttgacatcagggacttgggaaaccagttgaaagagcttggaatgttaatcgtacaggatgcggtctggaacagggtatcgcagaaccgggagcgtaagattgccacccgctattattgtgatgagttccaccttttgctgaaggagaagcagaccgctatctattcggtggaaatctggaagcgtttccgtaagtggggcggtattcctacggggctgacgcagaacgtaggcgattttttgaagtcggaggaaatcgagggaatcctcggcaattccgattttgtatatctcctgaatcaaaatgcaaaggatcaggcaatccttgcagataagctgggattgtcagaaaaacagcttgcccatgtaaccaattccgagccggggtgcggactgattctgtttgacaacgtggttattccgttcgtagataaatatccggtagataccaagacctttgcggttatgaataccaaaccagaggaaagtgtaaggcaggaggtaaatgagtagtggcggagaaaaagaaacagaaaccggctgcatttgcacaggagaaaaaaacctttaccggagaaattccaaagaaagcaaacgagggtaaaggtaaaaaatccgcagcatatcagccgagagatgcagataccacttctggacacgatgtccagaggtcgaaaaatacaaagaagtatcagaaagcagatgcttctggacagaatgtccaaaagtccgagggagcagaagccggagagaagtctaaaagcgattttatgcagccggacagcacttttacggaggaagccggagaggagcagggtagaaaaattgccagcgatgactaccgccacagggacacctatcattcgtcacagaaaaagggcaggtatcaaaggcgggagataaagagccgggagcgagtaaagcaatttgattttgaacaggatttccagacaaaggacactacctttaccgaagaggcagaaccggaatttcatggaagcaaaaagttagaccgactgcaaaagaaagcggagaaagccagaaaaaagacggaagctgcaagaaagaagattccaaagaaaacggagtattctctggagcgtgtttttgatgaaaagacgggcagaacaaagtatgtattgacttctgtaaaaaaagagaaaccattcaaaccggacagtccggtaaaaagagcggctggcagggtgggaatggaatcttctaattttgcccacagtaaggttgccgaagtggagaaagaaaattccggtgtggaggctgcccacaagacagagcagagcggggaagatgtttaccgctttttcaaagggcattacaaagggaaaacggaaagacggagagcgaaagctgcaaagctggagaaaaagcagatgcagaaagaggtcaatttccgttatcagaagttcttggaagaaaatccggaaatgcaggaaaagaccattcagaagcagttgcagaaaagactgcaaaagcagcgtatcaaacgggaatatgcaaaagcaagacgggcgggacagacagcgaaagccgcaaaggaaacagcggcgaagtccgggaatctttttacagcggcagccagaaagatacaggagattgcatcaaaaaatgtttcgcttctgcttgccataggagccttttcggtgcttcttgtgatgattatgacagcagtatcttcctgtggggcgatgtttgccggaggaatcagtaccacgctggcaggaagttatatgagcgttccggcagaaatagatgcggcagatttagctttttctgaactggaaaaagaattgcaggcagagattgatgccatagaaaccacttatccggattatgatgagtaccgttataatctggcatctatcgggcatgacccatttgcactgatcagctatctgtcggcagtccatacggaatttactgcaagtgaggtacaggcagaaatagaatatctgtttgatgaaatgtatgagttgacactaaatcctacagaggaaacgaggacaaggacggtaacaaaaacaggcactcatacggtaacagacccggttacgggggaaacaacagaagaggaatacgagtatgaagtggaagaggaatataccgtaaccattctggaagtgaccctgacagcaaaagatttaaacgtagtagttgccggacgcatgaatgaggagcagagagaaatctatgctttttataaccagacccacgggctgacacagcagttttataagccccttgatttatattggtacaactatgtgagcagttattatggctggcgtatcaatccggtcacagggcaggaacagttacatcggggcgtagatattgcagtacctaccggaacaaccgtatatgcggcgatggacgggacagtaactaccgcaacttatgacagctattacggaaattatgtagtgattgaagatgaaaaaggctactgcacaaaatatgcccacatggataccttaaatgtccgggcaggacagagcgtgacgcatggaaatgtgatcggaacaacagggaatacgggaagcagtaccggaagtcatttacatatcgaatgtctgtatcagggggaatattataaccctcttttttattttgaagcaggcacggatacgctgtatggcgaaacgccgggcagcggaagcggcggaggaaatgtgataccgccggattcctatgacgatgcaaccgtgcaggcacttatggaagaagcggcgagatatttagactatccctatgtatggggaggctccagtccgtccaccagctttgactgttccggttttgtctgctgggtatttacaaacagcggtgtccataacctgccacgaaccacagcacagggcatttataaccagtgtacgcctgtgtcggcggcagatgcaaaggctggggatattatcttttttacaggtacatacaattcgggcgtaccagtcagccatgtggggatttactgcggaaacggggtcatgattcattgcggagatccaatcagttacgcttcaatcaattcgtcctattggcagagccatttttatgcgtttggaagattatcaggaaattaaaataacaggaagtgaggaacgatgacgaaagagagaattgtaaaggagctttccaaagtccgggaacagcttgcgggattgcaggcgagggagagggatttggcggaacagcttcagatggcagaggatgcggagaagatgaaattcattgaaaagaataaaatctctctggatcggctgattctgttaaacaaggtcagcgaagaagaaattatgcgtctgctgaaagaaaaagagcagaaagaagcagcacaatcagaagaaagggaggcttacagccatgaagaacaggaagttatcatctaaggcagttatatcactgatattgtccgctgtgctatttaccatgcctgcggtagcgttttctgtaaatgggaactacgcaatcagcgcttttgccgaagaaacaaaagaaaccgaagaatccaaaccggaggaaagtacggagcagacacccggcgaaagtgaaactgatgtcagtacggaggaaaatacagaaaacagtaccgagggaagcacggaagaaactacggagggcagcacggagggaagcaccgaaggcggcaccgaagagaatacagaaggcagtaccgatgaaagcaccggggatggcactgtatcgggaaatgataaaccggagccggtatgtaattgcgaagatcaatgcggtgcgtatgagtatgacaaaaactgtcccgtctgcgtcacagattataagctctgtacctataaaaaaccgaatgtgagtatcaaaatcagacagccggaggagtggcataatgacattgtttccgtttctttcagtgtaaaagataccgcagatacggggaattttgaaatcgcaaagatagaggcaaaggtagggcagaatggaagctggacagatgtgacggaggaaaagaaattaaggatttccgagaactgtaccgtgtatgtgcttgtcacagaccagaaaggcaatacctatgagaagaaccgtgccataaagtgctttgataccgtaaagccgaccttaaatgcggcagtcagtgacgggcttttaagcatacaggtacatgatacggattccggtgtaaaggcggtatatgtcaatggatatgagtttacagatctgacgggcggtacgttaaatatccgcctccagcagtttgacgcagggtatgagtattttaccatttctgcaatggacaatgccggaaatatgtctgaggtttataaaacgaaaaatccgtactataaagaccctgccgataccagtgatgggaatccggcggagcagctcccggagagtgcgaccccgacgaaaccggggagtgctacgggaaccgtgacggagcataccaaaacagacagtaacggaaataccacatcacagacaagtcctgccgaacagaaaaagcaggcaatgaaagaagctgcggaggcagaaagcgggaaaacagaaagtacggaaaaatccggtcagggcaaggagttttatactattcagaccgccacggagaaagttttctatctgattattgaccgggacggagaggaagaaatggtatattttttgactgaggttacggaaaatgacctgttaaatgcaacttccgataacagtgaaaccttgccgaaaaattccgctgcgttggaatctgcaattccgaatggggagagtgcattgccaaacaacaacggagagcaggcagatacagagggaaaggaaacggaaacagaaaaaggtacggaaggtgcagagagtacgggaaatacagaggaaaccgaaccggagccggaagtgaaagaagcaccgaatccgatgatttcgtatgtgctgattggtagtcttgccttaatcgttatcggagctgcttattattttaaggttgtccgcaagaaaaaagaggactttatcgaggacgaagatgaagatgaggaagataacgaggagtatgaaaacgaagatgaggaatcggaggaagatacggaagaagatttctttgacgaacaggaggaataaggtatgcagttggtggttacagagaagcccagcgtagcacaggcaatttcccatgtgatcggggcgaaagagagaaaagacggttacatggagggaaacggatttctcgtttcatggtgtgtaggacatctggtagagctggcacagccggagatgtattcagaagcatggaaaaaatggagctatgagagcctgcccatgataccggagcagtggcagcatgaagtgaaaaaggaaacagcaacgcagtataaaatcttgaaaaatctgatgcacgatacaagagttgaaagtgtggtgtgtgccaccgatgccggacgggagggagaacttatcttccgtctggtatatgaacaggcaggctgccggaaaccaatgaaacgcctgtggatttcatcaatggaggagagtgcaatccgtgacgggtttgaaaacttaaagccgggaagcgattatgacagcctgtaccagtctgcactttgcagacagcaggcagactggctggtgggattaaatggtacgagattatttactgtactgtatggcggaaaggtattaaaggtgggcagagtacagacgcccacccttgccatgctggtagaccgtgaagtgaagattatgaattttgaaaaagagcagtattacatggctcatattctgatggatgggatagatgccatgacagaacggattgacgataaggcaagggcagaaagtattgctgcagcgtgtgaaagtcagagtggagtggttcgttccgttataaaggaaaataaaagcgttgcaccaccaaaactttatgaccttaccacgcttcagcgggatgccaaccgtatctttggttttactgcaaagcagacattggagtacacccagagcctttatgagaaaaagctggtcacttatccgagaacggacagccagtatttatccgatgatatggaagaaactgcaaaagcggtaatcggggcagtttatcaggcgattctctttgaggaacagaccggagcagagccggatataaaaagagtgttgaacagtaaaaaagtgaccgaccaccatgcaattattcccaccatagaaattacaaagacagacctttccgctgtgccggagggagaaatgaaaatcttatcccttgtcgctaatcgtctgttatgtgcaaccgggaaaaagcagttgtatgaaacggtaaaagcagagttttcctgcggtggttacagctttcatgtatccggaaaaacggttctgcagaacgggtggaaagaatttgaagcagcattgaaacgtacctaccgggtagaaaaaacagatgaggataaggaagagaagaaactgccggagctttctgaaggcatgacgtttccagttatccagacaaaggtaacagagcatttcacgcagcctcccaaacattttaccgaggacagcctgctttctgcgatggaacgtgccggagcagaggatatgggcgatgaggtggaacgcaaaggacttggcacacctgccaccagagctgacattattgaaaagctggtcaaagacggttttgtgaaacgggagaaaaagcagatgcttcccaccgaggacgggatgaagctcattactgttctgccggatatggtaaaatccccgaagcttacagcagattgggagaatacgctgactttggttgaaaaaggcgaatacaccatgcaggagttcatggatggcattgaagatatggtgcgggagctggtgcaaacctaccacagtatcagtgacgatcagaagtctttgtttggaacgatgcaggaagtgcttggaaaatgcccgaaatgcggcagcgatgtagtaaaaggaaaattcggtgcttactgcaaacaaaaatgcggcatgaatgtgggtagggcaatgggagcaacgttttccgatacacagatgaaaagtctgcttgaagggaaaaagacccttgtgagaggattaaaagggaaaaagggaagctacgatgcgtacctgattccggagggaattgaggattattcttatatcaaagacggaaaggaaatcaaaggttcgcagtacaaattcaagatggaatttccaccgagaaaaagcaagtgaaaaggagacagaaaaatgaatacagaaatgaaaaagaccgttgtttacagcaccggagataaaattttaaacattatgaaagagcaggatatggatattccagaactttctttgcggtgcggtgtcagggaagatgtattgatggatattctggcaggtatccgggaagcagatataagtacgctctgcaaaattgcagacggactggagatttgtgtacgggagctttgccctgatgaagaaagctatgtcgttccggtggaaaaagatatccttgcaaagctcattgtgatcagcgagctgaaggagatggaattggaggagctgattggcacaattctggaaaacggtatcgaagaacacggtttttatgaataaggcggcgggggttatcccctccgtcattttggaggaatgcttatggtaacaaaatatcagatgatttcctatctggcggaggataccgcaaaagagatagcgaaaaacgggcaggagtggacaaggtatctgactaccgctgcaaggctttataaatatccgttcaatgaacagatacttatttttgcacaacgaccggatgcaacagcctgtgcgtcccttgaactatggaatgagaagatgaattgctgggtaaaccgtggagcaaagggaattgccctgctggatacggaaaattcctatacaagattgaaatatgttttcgatgtgtccgacgtacataaggcaaggcggataggacgtgatccgaatttgtgggagttgcgtgaggagcataaagaaacagtcctggcacagcttgaaaagacatacggagaaacggataaaaacagctcctttgaacagcggataatggaaatatccaatcggattgctttggattattatgaagaacttctgccggaaatcgaatatgtgaaagagggcagctttttagaggaactggacgagttaaatgtaggtgtcaggcttcgtgatacgctttcttccagtattgcttacaccatactgtcacgatgcggtgcagatatggaactgtggaaagacgagcagggatttgaatatatcagcgactttaatacgatgaaaaccctgtctgttgttggtacagccaccacagatatgtgcaagccgcttttaatggagataggcagaaccataggagcgtatgaccgccagattgcccgcaggaaggcacaggaaaaagctaatgcaggacgcacacaaacttctttggaaaatacggagaaagtgcttgcaaatgaagcagatacagactataatgctttaaagcgtgaaagcgaaaaggagctacaaaacaatcaggagatagaaatacagagcaaaaaggaggatgcggcacatgaaactgacatacgaaaagaacggggattatctgattccgaacctgacagcgaacgaggaaccggagggaacgctgacgaagtacggtatgatgcggaagaacttcttacaggaacaccggaaagggatttatcagggcatgatactggcgggcgagctgaaagcacactgtctggagatacaggagcaggcagagcagagaatggaagccctgagcgaacagatggcgaaagcagagggagtgaacgaggaactgaaagcagccgatcagatgaagtgggtagcgaagatgaacaacatcagacattcagcggaggagatcgtgctgacggaactgatttacagttagaaaatgacatacaggaagaagaaataccagaaccggatagtggagaacattcattatccggttctttttttccgaagctgtctgaaacagagcagggggaggacttacagcgtggtattttatgcagtgatgagttcctgaagcataaaagaccggaaatagctgggtattttcagatagagcaggatgcaaagattcaggcggattatctgagaaattcgttccgcatggaagaatacaccgagttcaatatcggggaaatgcggggcggctaccgtgccgatgaggacggtattaccttatggaaaggcaattatctgacccgtgaagcggaaagcaggctgtcatgggaggaagcacgttttcttgtcaattcctatatggaggacggagtatatcttcttccaggagaaaccgcagagcggattgaaacagcgggaatgtaccagcagcttgacttattttccatgtttacggagcaggctggcaatcttgccatgaaacaggcggaaacagtgacaccgatacggtcagaaacaaagataccgccggagcagatagcggatattctgcggagcggcggaggcagggataacagcagaaagcgtatctacaccaaatatcagcagggaaagacaccggaggagatggctgctttcttacagaaagagtatggaacaaccggaaagggctttgaatttgacggaaagcagttagcggtatggttcaatgaggatgggatgcgtgtcggatatggcacatcgacagagcgtccggtgcttcagatgaactggcaggaggtggaagcaaaaatccgctcacaggtagtaaacggtacctatatgggagcaaatgaagcttatctgactgacgaagcagaacgtgaccggattgcagggcatctctttttctttttccgggatggcatgggagaactgccggaggagcttgggctaaaagcaggaaattatccggaggctcatgcaagaatgatagaatacctttctacaaaagaaggagttgagcttgtggcttcccacatggatcaggcacttcatcagcttgaaaccggagagaaaaagctacgtttccgttcagttatgccaaaagaggagctgcgggaggaacttgacaatctgctgatagaaaaacaaatctttccaaccgcagaccatgtggaaataaaaagggaggattttattactcaggacgagatagaccataatcttggcaggggaagtggatattcacatggttctttccgcatctatgattattttcaggaaaagcatgacagcaaagaagcagcggaatttctgaaaaaagaatatggcattggaggcggctctcatgcacttgccggagcagaccatagctggcaagaccacaactttaaagggattgaattaaaaaagggaaatatctgcgaaccttatgcgaaagtgctgctgtcttggaaagtagtcgaaaagcgtatccgaaagctggtggcggaagataagtatttatctccggcagggaaagaagcctatgcccggtacaaagaggaagaagcacagaaagcgctggaaaaagcacaggcggtaatagaacggaaaacgaaggttgcctgtaaagaagccattgaacggacgatttcggaaaaatttgacgggtatcgtctgccgaaagatacaccggatgaagtaatccgaaaatatggtagcgagcgtgtcagctatgtacttgccaatactgtcatgcacctgacgcacgatggcagattttctcccgacaataaggcatgggcaaaagaaatagaaccgtatgccaagtatgagaaccgtgatttgattgtttcttcccatccggcggtcttaaatggatttatcaatcagacaagacggtatatggagcaggaaaaggagattgcggcacagcagattaccattgacgggcagttgtgtttaaagattgatgaatggaagtcggaagaaaataactatgtgcttggaaattccatgcaggacaatgcgttcttttacgtactcataaacgaaaatgtccattttgaatatgattacaaaccgagcagggaagaaattgaaaacgattatttgaatctcattgcaatggaagatatagaccgacacgaagcggaggtattttcacgcattgaaggaacggaagatgtagcggaaacagaatcacgattctcagttgaggaaaccagcgatgcctttgagccgggacaggattttgcagtatgggatcatggcagggaagattattatataaaagaggacggtacaattcccacctttgaaacaaaagaggaagcggaacactatctgcaaagcatggaaccggacacttctggacacgatgtccaaaagtcagtggaagaacctgccatagaaaagcctgtgaagcagcctgcaccaaagattgataaatccaatgcggtcaatttccacattacagacgatgcgttaggagcaggcagtgcgaaagagaaattccgacgaaatatagaagcaatccgtactttggaaaaggtggagagcgagaaccgtatcgccacacggtcggaacagcagattttatcacagtatgttggctggggcgggcttgccgatgcctttgatgaaagcaaatctgcatgggcgggagaatatcagcagttaaaggaattgttatcgtcgcaggagtacgcttctgcaagggaaagcaccttaaatgcccactataccagtcctgccattatccgcagtatttatgataccttagaccgtatgggatttgaaaaggggaatgtattagagcctgcaatgggtatcggaaatttcttcggaatgctgccggagaagatgcaggaaagccgactttatggtgtggagctggatggtattacgggcaggattgcaagacagctctatccgaaagcggatattaaaatatccggttttgaaaaaacagactatccgaatgatttttttgatgtagcagtcggcaacgtgccattcggacagtataaggtagcggataaacaatatgataaaaataatttcctgattcatgattatttctttgcaaagacattagataaagtccgtcccggcggtgtggttgcttttgttaccagtaagggaacaatggataaaaaaagtccggaggtcagaaagtatctggctcagcgagcggagcttatgggggcggtcagacttccgaatacagcatttaaggaaaatgcagggacagaagtcacttcggatattttgttttttaagaagcgtgaccgtgtgatggacatagaaccggattgggtacatttatcagaagatgcaaacggtatcgccatgaatacctactttgcggaacacccggaaatgattgttgggaagatggaaatggtcagcggtccctatggcatggaaagcacctgccaaccggatgccacaagaccgtttgcagagcagttaatggatgcggtcagccggattgacggggaaatcgaagcagtggagacggacgagcttgcggatgagctggcagatgccaccattccggcagacccggacgtaaagaattacagctacacactggtggaagataaggtatattaccgtgaaaattccattatgaagcctgtggatatgtcagaatccatgcaggaacgcataaaaggcatggtaggaatccgaaactgtacgcaagagcttatcaatttgcagttggaagaatatccggatactgtgattaaggaaaagcagaaagaattgaataccctttatgatacgttcagcagaaaatacggtttaatcaattcccagaccaacaaaagagcctttaatcaggacagcagctattgtctgttatgttctctggaaaagctggatgacgagggaaatttcaaaggcaaagcggatatgttcacgaaacgtaccattaagaaagcggaagtggttacaagcgtggatacagcaacggaagctctggcagtatctttatcagaaaaagcaaaagttgacctttcttatatggcggagctgaccggaaaagagattgatacaatcaaagaagaactgacgggcattatctttcagaatccggtcacagacaggtgggaagcagcggacgagtatttaagcggcaatgtccgggataagttgcaaacagcgaagatttacgccgaaaaccacccggaatacaacataaatgtgcaggcacttacacaggtgcagcccacagaactggatgccagcgagattgaggtgcgtatcggtgccacatgggttgaaccgaaatatattgaagatttcatgcgtgatgtttttgaaacaccgcagcatctcttcaaccggaatacaatggggattcagtattccgatgtgacaggacagtggaatgtaaaaggaaaaagtgcggattacggaaacagtcttgtaaatatgacttatggtacaaaccggagaaatgcttatcagattttagaggattctctgaatttaaaggacagccgggtgtacgataccgtgatagaggacggaaaggaaacgagagtcctgaataaaaaggaaaccatgattgccagtcagaaacaggaggcagtccgggaagcctttaagaactgggtatttgaagatcaggaacgtagacaggacttggtggcgaaatataacaagctctttaattctaccagaccaagagaatatgacggttcccatttgaaattccctggcatgacaccggacatcgaccttagaccgcaccagttaaatgcggtggcacaccagctttacggggacaataccctgcttgctcattgtgtgggagcaggaaagacttttgaaatgattgctgcagcaatggaaagcaagcggttagggttatgccaaaagagcctgttcgttgttcccaatcatttgacggaacagtgggcgagtgactttttgcggttatatcccggagcaaatattttagcggcaacgaagaaagattttgagccagccaaccggaagaaattctgttccagaatcgccaccggagattatgatgctgtcattatcgggcatagccagtttgaaaaaatcccgttgtcgcaggaaagacagataggcattatcgaaagacagattgatgagattgagcttgccatagagcaggcgaaagcagataacggggagcgttacaccattaagcagatggaaaagtccagaaaatcccttatgacaagactggaaaaactcaacgatacttcccggaaagataatgttgtaacctttgagcagttaggtgtggacaggctgtttgtagatgaaagtcacaattataagaacctttttctatacacgaaaatgcggaatgtggcgggcattgcacagacggaagcacagaagtcctccgatatgtttgctaagtgccagtaccttgatgagctgactggcggaaagggcattacgtttgctacgggtacgccgatcagcaacagtatgacggagctttacaccaatatgcggtatcttcagtatggtacgcttcagaagatgggattagggcattttgacagttgggcagcttcttttggagaaacacagaccgccattgagctggcaccggagggaacaggataccgggcaaagacaagatttgcaaaattcttcaatctgccggagctgattgcacttttcaaggagagtgcggatatccagacaccggatatgttaaagctgcctgtgccggaagcagaatatgagaacgtggtgctgaaacccagcgaatatcagaaagagatggtaacatcgctggcagatcgggcggaggcagtgcgtaacagactggtagagccgcatcaggataatatgctcaagattaccaacgatggaagaaaactggcactcgaccagcgtctgatcaacgatatgctccccgatgaggaacattccaaagcaaaaacctgtgtggataaggcatttgagatttgggaagataccaaaggggagaaatcagcacagcttattttctgtgatttatcgacaccgaaaggagatggtacatttaatgtctatgaggatataagaaataaactgatggaaaaaggtgttcccgcagaagaaatcgcctttatacatcaggcaaatacggagcttaggaaagcggagctgttcagtaaggtaagaagcggacaggttcgttttttattgggttctactgcaaaaatgggagccgggacaaacgtgcaggacagactgattgctctgcaccacctcgatgtaccgtggcgtccgtctgatattgaacagcaggaggggcgtattttgcggcagggcaacaggaatccaaaggttaagattttccggtatgtgacagagggaacatttgacagctactcatgggtgcgacacgaagtcgcttaatttaactgtttggcggtaattccgaccaaaccatccattccgttggatgaagccaatatccccggctttgccagtaatggcattgttcggaagcggatataaatggaaccctatttggagcaaatcccgtgagggagaagcaaaactgccagctacaaggcggttagggtgcaggctttctgatagcatggttaattaactgaatcaccgtaagcttcgttaaggctgaacaagccaaagtagctgacaggcttgaaccaaaaggtgtgcagttggatattcctctccacgataggaatacacggacataagactgccggagtagaggtggaacctaaactatcaatgattgttgattaagtggaacgtgtcaagcccgtattctcgcctgcaaaggcaagtggaccgtaagggaagccgttgggaatgcgggtaaaggattgcggaggaagcgaatgccgaccttgtaatgaggacggataggggttcaaaatttgccccacccgaaaggggagcagaattccgcatggtgcttaattacgagagagtttatagaatttttgaaaggagtaaggcaaatgaacatgaaaatgtgtgcgacttctgacgttgcaaaggcatgggacagcatcgactggaacaaagcgaatgcatacgttaaaaaactgcaaatgcgtatcgtaaaggctcatcaacagggcagaaccggcaaagtaaagtctttgcaatggctgcttacacactctttctacggacgtgctttagctgtaaaaagagtaacgagtaataaaggcaaaaagacagcaggtgtagacaaaatcttatggtctactcccaaactgaaatatgaagcaattctcagcttaaaacgcagaggctataaaccattaccgttaaagagggtatatatcccgaaaaagaacggaaaaatgaggccgctcagtatcccatgtatgaaggatagagcgatgcagacattgtacaaatttgcactggaaccgattgcggaaatcactgctgaccctaactcctatggatttagagcaaagagatgtgtacaggatgcaatcgaacagtgctttacctgtctgaataaagcaaaatcccctaaatgggtgctggaaggagacattaagggctgttttgataacatcagtcacgaatggatactgaaccatatcccaatggacagagatattctgcgaaaatggttaaaaagcgggtatgtcgagaccggaagattatttccaacagacctcggcagcccacagggttcggctatctcaccaactatctgcaacatggtgttggatggtctggaagtccagattaggaagaaataccacaaaactaaaagggatggaaaagcatattttccaaaagtgaactttatacgttatgctgacgatttcatcgtcacaggcgaaagcagagagcttttggaagcaggtgttctcccgattatccgggaatttttatcagagagaggattggaactgtcagaagaaaagacagtgattacccatatcgaagatggttttgattttctcggatgtaatatacggtggtataaagacaagcttcttacaaaaccatccaaaaagaactataaagccattgtgaataagatacgggggattataaagcaaaatccatctatgaagcaggaagatttgataagaaagttaaatccggtcatcagaggatgggtaaatttccaaaagtataatgtctcctcgcaggcgtttgacaggtttgatttcgatgtatggagatgtctgtggagatggtgtaaacgtaggcatccgaagaaaagccacaaatggatagcaaagaaatatttcaggagagtcggcacaaggaactggacattcagtgtaaatatggcagactcatttgaattacatctgatatatgctactgatactaaaatagtaaggtggctgaaaacaaaatcagaagcgacaccatttgatgagcgtttcacagaatattttgaggacagaaacacaaagagaatgcttcgagaaatcaatggaaggaaaaaattaaatgcactgtacaaaatgcagaaaggcatttgtccgcattgtggtgaacctatcacagtggaacggggattccgaatccatacggaagtgggagcagattttaaagaaacgaatgtcttattacatgctgattgccacagagaacttcattactcgaaaaatgttgatgaactggttctgctaacgcagggcttataagtgcttgagccgtgtgaggggaaactctcacgcacggttcttagaggggaaagcggtagtaataccgctgacctactcgaccagcttatcgagaataagcagaaatttatcggtcagattatgacaagcaaatctccggtgcgaagttgtgaggatgtggacgaagcagcactttcttatgcagaggttaaggctctggcaacggggaatccctatataaaagaaaagatggatttggatattcaggtcagcaagctgaaactgatgaaagccaaccacaccagtcagaaataccgtctggaggacaacattgcaaagcattatccacagcagataaccattctgaaggagcgtatcagtggcttgcaggcagatattcagactgcaaaaaccaatctcccagcagataaggagtttttctctatgagggtcgggaataaggtctatacggataaaaaagaagccggaactgcacttgtggagatgtgcaaagaaatcaagagcgttaatgctccggcagtcattggagagtatgcaggctttaaaatggcggtgtcctttgattcctttaaccataaattcgttatgaacatcaaaggacagctcagtcataatctggagattggtgttgacccgctgggtaacatttcccgtatcaaccatgcgttggaagccatgacaaaggaactggcagaagcatccacaaagctggagaatgtggagcgtcagcttgaaacagcgaaggtagaggttacaaagccatttgcacaggaagcagagctttcagagaagttagaccgcctttctgccttaaatgccctgctcaatatggacgaaaagggagatgacggaataggtatggaagatgataaatcggaactgggtactgagcaggtggcagataccagaaaaccgtatcccatagaaaatacccgacataattatgctgtggagaatggaaatccgcagggaatgaggctcacagcagcgatggcggataagccggcacagagggtatccttgaaagaaaagcttgagactatgaaagtaaaggctgcggggaataatatagaaaattccgtgcaaagagataaggggaaggaggagtatttgtaattattatatttctttttatgcaaatatgaaatataatattagttcaagggaaatatagtgatagagcgatttggaaaaagctaaagagaaatggagacaacgtaatacataaaaatggaaattgaatttgtcagacactgtctgacaaattcggaaaggatatattatgaatgatttagagcagacaaatatgcttcagccattggtggatgagattgaaacagcagtttcaaatgccaaaaaagagatagctgaaaaagtaaacagtgtaattacagagacgtattggaaaatcggaaaatatattgttgagtttgagcaggatggaaatgttaaagcagcatacggttcaaaattattaacaacactctcgcatcaattaactttgcgattgggacgaggatacagccgcccaaacctcaacaatatgcggaagttttatctttgttatgagaattgtcagacggtgtctgacaaattgacatggtcgcatatttgtgagctgataaagattgatgatgaattagaaagaagtttttacgaaaaagaatgttataaggaaaagtgggatgtaagaacactcaggcgacagatggattccgctttgtttcttagattagctacaagcagagataaagaaggaattctggcacttgccagagagggaattacttatgacaagccagaggatgttatcaaggatacttacacattagaatttttgggacttccggagaaagagcgttatagtgaggaagacttggagcagaaaataatagataatctccaaaaattcttgttggaattaggaaaaggatttacctttgtgggcaggcagtatcccttaactgtaaacaatattcattaccatgtggacttggtattttaccacagaattttgaaatgctttgtgctgattgatttaaagaaaaattccgtccagcatatagacatcggtcagatgaatatgtatatggggtatttcgcaaaagaagaaaatatggcagatgataacccaccgattggcattatcctgagtcataacaaagatgaactgcttgtagaatatgcaacttacggtatggacagcaatttatttgtttcaaaatatgaattgtatctgccaaatcgcaatgaactccaaaaattagtgaacaatattttagagaaggatacagaaaagaaagaagagtaataaaaaagcaatctaaaaaagatgcaaattgaataggcatatcgaaaaagacaatcagagatggttgtcttttttgcgtggaaaaaagaaaggacaatcgaattatggaagataaaaataccgtttacatgagtgaaaagcaaaaagtcaaagagattacggataagctggaagctggtttgaaagagctttttgagagtgaaaaatataaaagctatctcagtaccatgtcaaaatttcataattacagttttaataatacgctgctgattgccatgcagaagccggaagctacgctggtggcaggttatcaggcgtggcagaagaactttgagcggcacgtcaataaaggagaaaaggcaatccgtattcttgcaccagctccttataaaatcaaagaggaacgtgataagttagaccctgtaacgggagaaatgatgtttgatgaaaacggtatgccgcagaaagaggaaacagaggttaccattcctgcctttcgtgcggtatctgtttttgatgtatcgcagacggatggcaagcctattccggaactggaagtgaatgagctgttatctacggtggagggatatgaggattttgtccaggcgcttatgaatatttctcctgttccgattgcatttgaagatattcccggcgattccaaagggtatttcagtacagcagaaaaacggattgctgttcaggaaaatatgagcgaaagccagactttgaaaacaatggtgcatgaggtggctcattccaggctgcatgataaagaagttaatcagagcatggatattccggtaaaggacaggaatacaaaggaagtggaagcggagagtgtggcttttacagtgtgccagcatttcggtatagatacatccgattattcctttggatatatcgcaggctggagcagcggcaggaatatgaaagagctgaaatcttcccttgatacaatccgaaagacagcttcagaactgattacaggcattgagggggcaatgcaggagcttcagcttaaccgggagatggagcaggaacatggaaaggaaagcattctgctggtacataacgaggatttttcagaatacaatcttgtcagtgtccgtggaatggacagtgcagaacttatatccgctctttctaccatgaatgaagaggataaatcgaatatatcatcttatcttgaaagcaaaggagcatggactaccgaacttgctgacgagcagacggaagaagcggaggaatatcatattgatgtccgctataacatggatacagacgagcttattgatgtaaaggaaagaatggaacaccccattgataccaatttatctgtcatggggcaggcagaacaacttatcaatcagttggaagcagaaaaaaatattttcacgtctgaggagcgaaatctgattgtaaattatgcctataaacttgatgatatgaataaaacaagggaacttgcagagaaactggcatatagggagcagtatgcccaacaggatgtggcattgaccataattgatgcaaaggcggagattgatgccctgcctgatccgatgattggtttgtcggaaatgagggaatatggctatcaatggaatgaaatgctgccattaacacaagagaaagcattggaattatttgaacatgatttgcctgtatatttgcttcatactgacggtgcggaatcattggcagaaagcagggagcgtatagaagagcatgaaggtatctttggggttgaaaaggaaacatggaataaagcattgaaacagcagactaagattacacttatcttaatggacgaacaggagcgagaatatacatacccgtatccagttgtggctgtcgatatagaagaaatgggtggggatagaactgcggtattcaagacctcagagcctatttcagatactgatgtggcagaaattcataatgctttttatggaactgatttggaatttgaaatagaaaaagaattaggtatcacatgggtggaatctattaactatgaggacggatctgttattacacctgaaatggcaagaaaagagcagctcctatatgctagtactgataaatatggaatttatcaattaaagcctaatccggaattagattccttacgttttgaggggacggaatccttaaagcgtatgggcattacaaaagataattttgatgcaattaaaccagagaattatacacttttatatgtgggcgaattatctgaactgcaaaaagagacgcagggggcaactttagaggcaatctttgaaaaattcaaccttgaccacccagaagatttcagaggacattcgctatctgtcagcgatatagtggtgcttcatcagaacggacagaatacggctcattttgtggattcttttggatatacggaaataccggattttttacgggagcagacaccggaaaaggaagaaatgcaggacacttctggacacaatgtccaaaagacagaaccggaaatagatggagatgaaatcattgatcttggcgatgaaacagaacaggtgcttgcggaaatgaaaaaaactttggaaagtgaacaggaaacagaactggcattttctattgcagaccgttttatcagcattcaggaagtggatggcggttatgattattccattatgggagctgattataaggagattgacggaggaatttatgataatcctgatgtgacgataagggaagccttgcatgatattttagaggatttgaagtcacagccggattacaatggtgcaaaaggaaatatccaaagagaagatgaactgataccgatggattatgatggactgatggaaaaagcagaggaagcaaatcgtattattccggagagtacaccaagcagtgtggtggcagattttaaggcaaagaccggggaattattccacgatattagtgaaatgaatccggaagaaatcgaggaaactgtgaaatgccatgtgcaggcgaagattgaagagtatgatattaatgcaacaatcgtggatgttgctgtaacaggaagcagatgcaggggattagagcatgaaggttctgaccttgatgtggtggtggaactttccacagcggaacgggaggacgatttatttaatgcctttaatgaggatggacttcatatcggagaagtaaaagttgacatcaatccaattacagcccaacgaacaggtacgctggaatcctatctgccacagatggaagaatatttggagggcgtcagacaggtaagagagcaggaaaaggagagcgcagaagtaactttaactgtttcggaatgtggagaatttcataatcttggtgagtgttatgagaatattcctacggtggatgaagctatagcaatctggaagcagataccttcagagcggatgaatggtattccggcaatcggaatcaatatcctagggagaggggcggaacccttcgaggattacgagattgatgttttatctggaaagaggattgaccttggggttttggactatgttcctgatattaaaaacaatccgcaggcaatggaagtcattacggaactggtggctaaattgcccgatatggagatagatggcgtgatgagtgaagaaatggaagcaagagtgtgggaactgcgtatgccggacttgccacaagaggaacagcttgcagtagaacttgaccgactttcctacgattatgatactgtactgtatcacgatagtacaagaaatatgaccgagaatgtatcagagcttgcagaatccataaaacagggcgataccggacatttaacaacgtggcttgcagacattatttcggagggagctgtaccagaggaaataaaacgagcaacggagcttctggaaaaactgacagagtataagccgcttgccaagattgaggaggcagaagaacagaattataatatgattgataatgtgctgaataatggtgttggggagaaagcccaaagggaagaaaataagagaatggaggagaagcctacggtaaggctttccttaaaatcccgtcttgcggagaaaaaatcacaggtagaagggcaatcgaaagaacatgatgttcaagaaaatgaaaagaaaagtcagagggagatgtaagtgatgaataagagatttaccgtagaagagagtaatttaatcagtatttttatggaagaaggtatagattcagatgtgggaggcagaaaaaatgtcataaatggtatcaataagacactgaaacatctggaggatgatgagatggttgaattgtcattatgtgtccttgcaaaattaaaggaattgacggatcatgaatttatgaagatggagtttgtagcggcagagtaacatcaaacgtaaggcagaacatggcttttggtggctgtgttctgtctttttgaataagaacttgactgataaatattacgggtgtaatatttataacgaaagggagtaaatttttttgcttcaaaatcttacacttgtaatatataagcgtagtacattgatacgaataagaaatggaggtaacgatgaaggcaaaacatagaaccaaaagaatacaaagatatagaaaaatgttgggcattatagtgttaatgttaacaattactttgattggagtagttgtgagtgcaacagtattatataaaagaaaaaatgcgtgtaaaacaccagatactatcttagtagagtatatgatgcatattccaaaacaagaatacgaagaaatgtatgcaatgattgatttggagtcatctggatatatcagtaaggaagattttctgaagagaaattccactatttatgagggaattgaaatgcaaaacatgtcgataaaaaatgtcgagtatgtggaggaagataaaaaagtaacatatttgacttcgtttgatacagtggcaggaactatcagctttgagaatgaggcattttttataaatggagaagaaggatataaattggtttgggatgattccatgatttttcctaatctgacttctgcagataaagtaagagtttctactacacaggcagagcgaggagaaattctggataggaacggacgtgtccttgcaggaaaaggtacagcatcttcagttggaattgttccgggcaagttggaaaacagagaggaagcaatcgcacagattgcaggactattggaaatcacaacggaagcgatagaaaagaacctgtctgcaaagtgggtaaaggatgattcttttgtacctattaaaacgattccaagagtggaagaaattgagttaatgtctatcagtccagaggaagaagttttaaaggagaaagaaaggcatgataagttgctggagattcccggagtgatgatatctgatgttgaagtgcgtgaatacccattaggggaagccgctgcgcatttggtcgggtatgttcaaagcgttactgcggaagatttagaggaacatgcaggagaaggttatacagccaatagtgtaatcggcagaagcggaatggagggcttgttcgagaaagaactgaaaggccagaacggttgcaggatttacattgtaaattcggaagataaagagaaggaggaactggcttgtatcctggtacagcatgggcaggacatccggcttacgatagatactgatttgcaggtttccttgtacgaacagtttaaggaagataaaagctgctcggtagccataaatcattataccggagaggtattggctttggtcagcacaccggcttatgacaataacgattttattatgggattatcgagtgagcagtggactgtacttaacgaggacgagaataagccaatgtataatcggttccggcaagtgtggtgtccgggatctaccttcaaaccaattatagctgcgattggtttacaatcaggagcaatcgatccaatggaagattacgggaacgtaggattaagttggcaaaaagatgcatcgtggggttcatatcatgtaacaacgcttcatgcgtatgaaccagtcattttagagaatgccttgatttattctgataatatttatttcgcaaaagcagcattaaagattggatcggatgagttggagaattctttgatacggcttggtttcaatgaggaactaccatttgagattaagatggcagaatctcagtattccaatacagaaggcattgaaactgaaatacagttagctgacagcggttacggacaaggacagattttagtgaacccgttgcatatggcatgtatttattctgctttctgtaatgagggaaatgtaataaagccttatttggtatatcagaatgaagcggaagttgagtattggattccgggtgccttttctaacgagacagcaagtcgtgtattggaaggaacaaagaaggttgtgaatgattctaatggaactggatatgcagcccatcgagatgacattcttttagcaggaaaaacaggtacggcagaaataaaggcatcgaaggatgatacttcgggtacagaattaggatggtttgcaatttttacagcagaagatacggaatgtcctatattgattatcagtatggtagaagatgtgaaaggaagaggaggaagcggatatgttgttaagaaagacagtctggttctggaagagtggtttagcagtcattagttttgtactgatgtttagtatttcggggtgtagcgatacaccaccggaagaagatacagtttcggaaacagtaattgatgttcaggacgtttcagaagaagaacaggagaatgaagaagaaattataaacatctgcatagatctttatgacaaggcagcagaggaaaataagttagatgatttggaaataattcggagtattgtaaatcgtcttggagaaaacgagtatcctgctgttgacagcagaaatcaagtgaatatgacggaagcggagcaggtactggaattttgtgaaaaggtggatgcacaggaagaagcagatataacgattcttgaagtcggctatttgggcggatttgtaaaatacgatttgcacacaaaagacggaaatgtagatgtggtcagaagctattatggatacgaaaatggagaaatacagaaagaagttactgggaggtatcaagcagagtattggaattatacagaagaaggttacctgatgttttctggtgtctggttttcagaagaattatacgttcttacattgagtggagcagaggagcataccgcattacgagtacagccattggatgaaacatatagggaactgagtcggaaatatcttcttccaatcagctttgaacagaataatatgtttattgtggattggagtgaagaagattttggggatttgaatttctatgatatgtatgacattctttatccaaaagtgaatggtcagtatgttccttatgttgcagatgacaatttgtcagtcagtgcagtttatcggattccaaaagaggaatttgaaagcgttattatgaaatatttcaatattgatagtgaaacgctgcaatccaaaactgtctatgattcggaggattcgacctatgaatacaaaccgagaggcttcgaagaagtagagtatccggaatacccatattcagaagtaatcgggtatacggagaacagtgatggaacaattacacttactgctaatgtggtatttccatattcgggaaattccaaagtatatgcccacgaggttgtggttcgtcctttggaggatggcggggtacaatatgtatccaatcgaattataccctccgaggataattctgaggaaacatggcatacgccacggttgacgttagaagaatgggaagaattatacggaggcgaataatggaagatgtgaaatggctgcttagaagatgtggtcttccgattttgctgctgttgattttcgtaatagccggagtggtctgttggggagaactgcatacagaaaagcaaaaggtggcagaagaagtatgggagccacctgtagaaatcgaaaatagcgaagcagaaacagaagaagccgagaatgcggaaacttccacagagtcagcatattggtttattccgcaagccagtgatgatctccttacagaagaggagaaggagcaactgcagagtacggttttgtcagcagcagaatcggtcagagaaatctataaggatattgtaattgcagatgcaccaagctactcttccggtattggcgaatttaccaaagagcagaggaaagctgtggtggagcaattgggcagaaccggtctggtaagtgttgaagaagatactgctatgcaaaatcatgaagcaatcgaagcattttatgcagattacctggatggacaagactcgatggttacggtatttgaagtacagagagatgggctgattggagcagttacctttatctatcggaaaggtgagttgcagacctattacataggaattcggtggagagaaggtggtatgccagaaatacagggaacttcggtaagtaatgtggctgagattaaactgaccgaaaaaggatattttatctacgcatatgaatatgtgattgcacatgcaagtttgagacagtattggagaatagaaccgctaccagaagactgccgggaattaacgcaagaatacatatcaggactaagttatgtgaattacaatctgctcgttaccgattgggatagcagcaatgtggaggacattctgatgccttgtatgtatgaagatgtttataggatttctacgggggaaaatctgaaaactgagggttggaagattccggcagaggaatatgaaaggataatgactacttattttccggtatcggtagaacagttgagagagcattgtggatatgatgagggcagcaatagctatgaatatgagatgatttatgccagtccatacccacctttcggagaagtagttgactatacccaaaatgcggatggaacgattacacttatcgtggatggagtatggccggattataattctgatctcgcttttcggaatacggttgtggtccagccatttgaagacggaactttcaggtatctttccaattctatagaacaaatagagttggaactgccgccaatagcaaaagcacattaaatttgctttgaaagaaaggatgatattatggcattaaagaaaaaaagcattttgctgattatggcatttctgattggatgcttcgtatgtgcctgtggaaaagaagatagtattgtggatgaatctcttgtggaagatacggaagatgtatcttccacggaggagataaaaagtgccgaggaagaggctgcagaacaatgggaaaagggctacgaccttccgttagatgaacaggaaagggaagaagctgagactgactgtaaaaagcagatggaactttatcttgacatttatgaaactgcagataaagggatagcatctaatgttgctttggatgatcaaacagttttggaaatgcagaggaagctaaaggatgcaggatgtccggttacaacaatggtaacatattctaacatggagaattatgaaagtgttgacagttttctgaaagaatgtatggaagggaaaagtggttctgcagtaatttatgaagtccacaacgatggtggattgggcagaatgaaattcatttttgatggaacagatatgtatgttgtaagtgcaaaaggaatctggaatgctgataataagccggggatttcatacatttcctatacaagactaaaagagtggaaatatacagataagggatggttctgctacgagttgtgtgtgccggagccaccggaggtcagtgaaattgtggatggaagcagcgtgattagaataaaacctatgacagaggaacagcgagagatgtctgagcgcctcgtcttgggacttggatatcagggacagaaccttttgtgttccaactggaatacggaaaatatgagtgaattggattataacggaatgtttgaatatctgtatggaatgaaatatggagaaaagttcaattccgaagattatccaaatggtattccaaaagaagaattcgaaagtctgattatggaatatcttccgataacagcggagcagatacgagagtacgcagtatttgacgaggaaaaccacacatatgattgggctcgattaggatgtggaaattatgcacctactttctttggaacttctttgccagaggtcacggatatcaaagaaaatgatgatgagacagtcacgttaacggtggaggcggtttgtgatatggttatttgcgatgatgcagtcataacccatgaacttacggtaaggtttgcagaggatggcagttttcagtatttggggaataaaatcctaaatgacggaattatgcagatacccgattatcaataccgaattaaagaatgatttgataatagttgtgttttgtggtaatcttacagatgtaagaaaaggaaggaggacacatgaagaaattaaaactagttggaatattggcagcagttgtattaataggcggtgtgatttcaattccgcttataaataaccacactgcttataaagtggaaaagaaattatgtgaaacaccactgccagagaaaacggaattgatagagtcaatatcacgggcagggaagctgacaggtaacggaaatggaatgcagtatttcggagcaattctaattcgaagtgacttgtctttggaagaattggatgcttactattcaaggtacagaagtaatgagtgggaatgtttggtgaaaattcaggaagggcagtccattgaggggattgatcacgggacactacaatttgcggaagaaataaaggacaggggttattacattgtatattcttggggaagtgaaaattctctattggatgaattggatatacgtggacactaaaaacgagatggagacaaattatgaagaaaatttctaatatatgtggttttattggaattgctatatatgcggtgctgatgattcgcatttcaaatctatgtcaatacggtgggacgaaagtggacttgattccaatattgattttgggtgttgttcttatagcaacaatcatttttggaattgttagcagtagaaaagaagaaaaaattgaaaaaggtaaactgttctggggaaaatgtattgtagttgttgccctgaccattttgtttggaggcaggattatttattcggcaatcccttataatggtgcattgtcatggaagattgacgaatggcgtaaccaaaagaaaattgaacttactcataccaacttctttgagacaggtgtagaaggaatcttggaagacattgagacagagttggatttaccggatgaactttatgttcaaaataagttccagctttcctttgacaaagatggtgaaattcagagtatttatacttatatgtatggaagatatgaaaatggagacgaaaatacattccttattgactatgatgtggatgcagattcaaaaatgactgtgtgtattaatggagttgcgagcaaatcttacgatgatgacatgagattacagccgatgcttgaaattttgaaaaacgctgattacaaaacaagagtaaataactgggctgtggaaggatatgcagacgattatgaaattctctattatggcaagcgggaatttaacacaatggaaggatttgtatatcttcaaggtgatgtggatggtgacggagtggacaacacagacaatgccatttattcggaactgaatggtggagctgtttatggatatgaagtctcgcttcatattccaagtgaatctgaggtgactccggtacgttattttatggaaccggaagtgattccgttagaaactatcatcgacagggaggaagagcagactattgatgatgctaaagaaacagaatcctggtatgtagataattccaacggttctgtatattactggttgtctgagaataaagaaattggatggagattagtagttactgatgcggcagcaggaagccgttattatgaattggaaaagtcatcagatggtggtgaaacatggaatgtgataaatgccaatccgtttaacaacaagattggcgtggcactgggaatagaattttacgatgaaaatcttggtgtgattggtatgacaggcgcttcacaggatgcctcaactttatatgtgacatcagatggcggagttacttttacacagatggaatttccaatggaagaggttacggaactgccggatattgctgatgaactaggatacacaatcgcagattatgattacgcagagatgccacaagtatccgatggacaatggactgtaatcatcaaggcagaatacagcagttacggaggcttgagatttacatctaacgacaatggaaagacatggatgtatgagggattaagtacaggcgaaggtgatttacaataagaaataaaagatacgaatagtgttaaaacacaaaaaatcgggtaaaagattgtacgactgactatgacctttacccgattttattatgttttatttccagatattcatgtctgacaagatagacatggttatttcagttgcgttgcctccggtagcatcgctgtctgcactaatgttggtggcaaaaaagtatgtattatctgcagtttcgatataaccgatgaaccatccgtttacatcctgtccattaacacggccagttccggtttttccgtagaatgttccggcatcggaagctgaaaggcagatggcatcttttactgcattgatattttcaggggcgaagccgaaactgttattctgcagcttggttaaaagttcgacctgttctattggagagatttccaaggaggattccatccaataagaggagaaatcgccactcatgttttcgttaccatatccgatttcttgaacatagctgtaaacgtcagaggttccaagctgttcgtctactgcttgaaaataccaattcacagaggagttcattgcagactgtaaggtctgatctgcgttccatgcttcaaatggataggtttctccattccatgcaatgaacgaattttctggtgtaatgacgccttcttccaatccgaacaaagcatcgtatatcttgtaggtggagtttggagcaacccgtaaggtggcatgctccatgtcatgtatactccatgcatcgttttccaaatcgtataaaacaaagctgccttcgtattctctgaagtatgtggagaggtctacataggaaatattctcagaagaggaatcccattggtagtggcttccatctgctgcgtatgtagaaataaaaggtgcgaatccaaggagaaggacagcagtcaacatgaatgcagtcataccttttactctttttataaatgtcggcttctcataagatgcaatgttgataattctccgtttcatctgcttcatgtttccaccaagaccggcggcaaacggaaatggagtaagtgaaatcttttccgcaaaattgatcagtgtattaccataatctgcataatcatcctcctcaagcatctttaaaacagaggtgtcacaggcaacctctctgtcattacgcatttctttcagagcataccagacaagaggattgaaccaatatattactccggcaaagttcattagatagttggcaatagcatctttgtgcttatagtgctgtagctcgtgtaacagcatgtatcgcatgtccgattcgttataatctgagatgagatgaatcggcagataaatacaaggtttcaaaagccccacaataatcggagatttcaaaaatgcagtactgtaaacatggatatttctgttaattcccatttctttcatacatcgatgatatagttttcggacttccgggttctgaaggggaagtgcagattttttcaagttctgtaagcggatagaggacttgattaccaatataatcattgcaaggatgcctacaagccatattccaaatagtatgtatccgatgctggatggagtctcactatttaccgaaagggcaaagtcattcatccagtctgcatttccggctggattgatcccaacagcttctcctatggcggttctggtgccagaagtaggagaacttttcaggctactgagccacgagaggatttgcggaaacccaattaaacggaacggtataaaaggaactaccaacaatccaagtagcaggaaccatagattatactgcatccggctggataggttgactttgaatatccgcttggctatcaaaagaattccgatgataccgctgataaatacattgcatattaaaaagcgtatcataaaatcagccatgttaattacctcctttttttgacctcttggaaagaagagagcggagagtgtctatttccgtttcggacagtctgtcattttctatatatgcagacagcatggcagtgatgtctccatcgtagtatcgttctagaaaagagttactttcctgaccgatgtattcactttctttcacaactggagtgtaaacaaacacccgactttgtttttcataagtcagaacgcccttgttcactagacgtttaattagagtttgtattgtttttggactccagttcgtagtctgtaataatttatcagttatttcattggtgctgatcggcgcatgtttccatacgattttcataacttcaaattcagcttcagaaatctgtggtaaatcgctcatttcaaatccctccttaaatcttacggctgtaataaaaatattatagatgttatttgtgtagttgtcaatttaagagaaaatagattgacttgaaatcttacttatgtaataattcaaatattacataagtaagaatttaaaaaaggagtggaatcaggatgattgaaattgtaaataaagtgctttgaaaataagaaaaccaatagagtcacaaggagtctattggcattcttacagagttggatggtcttgcttgtgcagcagatcaagcagataacgaaccataggcaataaatccgcagcctcctgttccgtgcagtcattcagcagggtcaggagtttttggagatttggctgttggtttgcgttggctgggtagaaaatcttatcggcgggtatcttcagatatgtaatcaaaggatacagcttatcatatttggggttaccacgtccggcttcaatatttagtatggtgcgggtatccatattaagagtttcagccagcttttcttgtgaaagtccgagttcggtacgggcttcacgcactgcaatggcaagaatttgttttatgtcatgcattataattcacctcgatagtagtttacaatacctattaaaacgagtgaattgcaatagaatacagtgtagatatggagtgtaatacatggatgtaaagtatgtgaaaatacatagaaaaagaatagtgaaaagttttgagatagcagcatattacacactaaggtgtatcgcaaagaagtataaaacttcaacgcgatacaccttttttgtggggaaatcagagcgttgtaaagtctttttccggtttgcggtttgtggtctgttcctgtcccggagtccggtcaagatactggttcagattatccagttttcggttgagagcctgtatgtctttttcagcagatttataggttttctgcaaggcttctttcttggcatacagagcattgtaatcattacgaaacttatcaatatcaaaatgttttaagctgattccaaagcgtttcagcatattttctgcaccgtcatggagcaggagttctgtttcatggtggcggagataagcgtcagggtctttcgatttccggtaacggatgtgatagatatgattgctctgatattgttcagcgtatttcaatatctgtcctaaatcctttagctgacgttctgtttccacaagactgttccgtgcggtttttgcaagaacagacttactttcaatctgtttttcaagctcgatgatagaacctgctttactgtaactgctggcagcgattttgagattttcaatcgctgcccaatgctgcagaccggggctttgcgtgaacttttcttccgaggtgtcaatgagcgttcgggaagaataatccttgataagaggtttttttcgggcagggaatgggacacgtttttgtgtctgtgctaaagcctttgtttctacccgttccttaatccgttctttggtgtattctgcacccaaagactttaagctgccacggacaaaatgctcccggtcaagggggcggaaggaaatgtactttaaggcgttttctccaatggtttcgcctttgatttcataaccttttgcccgtatcagctccatgcactgttcatatgtatcagcgttttgaattgcttcatcaatgtcctgcttgagcttgattttccacgaggtgccatttctgccggatgtccattctttataacttttaccacgctggtttgtgggagaaatgacggataactgatgcttggaacacagctcatcattcaggcggcgaatgtggtagtaggtctgtttacagtcatgatatttttcgtgattcacattatctgcggcacagaaaatgatgtggttgtgaacgtgacctttatcaatatgagtggaaacgatataagaaaatttcccctctaacagcttgtcggcaagctccacaccgatctgatgtgcttccttataagatacctctcccggagcgaaagcctgtatcagatgaaaggctttgttggggtctgcctgatttgtttttgacagagcaaatttgaagtcaaaggcagcggtttcaggactgcatccgaaggaagaaatgagactactttcatctgttttttgggaattacagatatagtttactgccttatggacggttgcctggatagcatggatttttgtgattgccatacctgtttcatcagctcctttacttcgtttacatcggctttatagacattgccagtagcattcatccgcttggcaatctggttcagattattgccgatacgggcgagcgtggtgttgtattcccgcaggtgttcgtagtttacatcgtagacatagccatacaaaatcagatgccgaataaatgcggatttgctcttcatgccggaggctttccatttctgatctaagatgtattgctcgtcatcgctgagatagattttaagttcattttgtctttctcggtttgccattgcagtatcagtcctttccttatttgtataaaagattttcaaatatgccgtagccggcggttgttttttgcttttagggggacagggggatatgccccatgcaagccaatttctgcaagttttcacttggtagaaatttgcggaaatggtgcctgtgagggaacacaggcagtgcttgctattcttctgcaaattacccgtagggaatttgcgtgttgcgtgagtataggcgagcggtttgcaacacagtagggcgttaccgcccttgttatggatagcgttgataattcgactttgcagttgggcagaagcaataaaaaaactgccacggttcataagggcattgattgcccgtaaaaactccatagcagtttgtgtgactttttatgatttttgattctatccataatgattttatcaatgggaaaggggaaagtcaatggctggagagagataaaagatttacagagaaatttaggggaataagcaaagatactgcatattctgcatttaaaattagaattggaaaaccagaagagagggggtgaagcatgaataccgtacatcgtagaacggaaataatcaatattcttattatcagacgacatacaacagcgaatgaattggcacaggaatttggcgtttccattcgcacgatacagtatgatattcaggctttaactccggtttatccgatttatacaaaacagggagagaacggaggaatttttataagagaggattacaagccttatgccaattcgctgacacctatggaagtagctgccttgcatgaattatatgattggacggagggcatacataaaaaagttttatttcaagtcctaagaaaatatggaccggataaattacaactttgatcttgtcattctgataaagcacataatttttacagaaccgttcatagcagacggaagtgtgcttatgtgctttttaggctgacaatttcagctttgattttatccaaaatgcagacgatgtctgcgattgtaccttgacaatttcataaaccaatgcgtacaggacgtgtggaatatgtggagccgctttgaggatacgccataagacacctgcttttgcctttggcagaggtggatacgaaggaatattgaaagcagatattgaagttaaggtgtggagcgagaaatatccggcataaatgtgtagcagttacacggaggcgttgatacatatttttgataatgatacttccggcttagtccggtcagataagatgacggtgcgataccgatgtgggtagtgtaatgagctgctacctgtacggattttttaatatcttccaataaaagcatatttgtttgttaagtatgtttttattggcagatatgccataaccatagcaagagaaaaagaacacactttgaaaaggtaggtggaagaatgcaggcaaaagtgaacacaaaaaattttataaggtatgacgagggtgcggagaggtattctatgagtaaacacagctttatgaaattggcacaggatgctcgtgctgtttataaaattaaccgtatcacattggtaaacgtgaagatttttgaggagtatttggaatcttttcgggcgtagacatgataagaaagaggaaaacgaattattgtatatcaaaaagtatttgactttttgatatacaagtagtaaaatgaagtcaggttatgaaaggcaggtgttgacggatggcaagaatgggtagacctaagttagaaaatccgagaagtgaaggtgtattcatccgtcttacaaaagatgagcatacagatataacagagtatgccagctctcatgatctgaccataacacagacgcttgttcaaggatttagaaagctgcaagagcaggataataccgagaatgagtaatggcatttgtgacctctttcttatattgagaggaaggtggtacataatgtcaatgtcgagaaaagattcaaaaggcagagtattaaggaaaggcgaaagtcagaggaaaaacgacggaaggtatatctaccagtacaccgattcgacaggtaaaaggcgggtcgtttattcaaatgacctgttggagttaagggaaaaggaaaaagaacttgttcgcaatcagttggacggtcttgaaagctattgcagtggaaagacaactttgaactatgcatttgacaggtatatttcaacgaagtatgatttgaaagaacacacacgggtaaattataagtatatgtataaccgttttgtcagagatacttttggaaaaagaatcatcaatgatataaagtattctgatgtgaaattcttttattgttcgttgatgaacatattggggttacaggcgaatacattggataatattcatacgattctgcacccaacctttcagatggcagttagggacaatgtgatacgcaataatccggcaagcggtgtaatggcagaaatcaaaaaggcgaatggaaagaataagggcataagacacgcacttacattggaacagcagagagcatttttgaactatgtatcgaacagtcctgtgtattgccattggttgccactgtttacagcactttttggaacgggatgtcgcataggagaaatgatagggctgcgttgggaagatttggattatgagaataaaaccattagtataaaccatgcggctatctatcgagtaatggagaatggaaagagtgaatttcatatttcttcgccaaagacagaagccgggattcgtactattccgatgatgcaggctgtagaacaggcatttaaggatgaatacgaagcacagaaagaaaccggttttaatgtgcaagtggttgatggtatgagtgggtttatcttttgcaataaagacggaattatccataaacccagcgtaatcaacagtgcaatcaaaagaatttacgaagcctacaatgccgaagaaattattaaggcaaaacgggagagcagacgcccggtattgattcctcatttttcgtgtcatcatatccgacacacattttgcaccagattttgtgaaaatgaaagaaatctgaaagtgattcaaagtattatgggtcatgcaaatattgaaacaacgatggatatttatgcggaagcaacagatgtgaagaaaaaggaagcaattaaagctctggaaaataatagtgatatattttaggaagaagtccttgcaaggggacgatttccaagacaaacctgacatcaaaaaagtcagaatacatcaaaatgacattagtttgttggattttggtggacaaatatggactggcgatatataatgaaaatcgtgtaaaaaagcgtttatcaacttatttggactgtggtggattagcttcggttatattcccgacaatgaagtctattgataagtaagaatgcaggaaaatcaagggtttcagcacttggatgtactaaaatatatagttggtcaaggggttttgaccaagatttgaccaatttttggcatagtcaaaaaagattagtacaggttagtacagattgcttagtctgaaaaattaaagattgtattacttagaggacattttctaaagaaatttagaagatgtcctctttttgcgttataggaacaattgaaataccgaaaggagaatagcatggaacacacaaaggcatatcaggaatttaagaagaatggtaatacaaagtttgtaagatatagcgaaggagcagaaatgtatcatatgggcgtatcaaagtttatgcaaatggctaaggatgccaaagcaatctataagttaggtcagttagtacttgtgaatttaaaaatatttgatgagtaccttgagacattccatatagttgatgatgaattttataagtaggtgaaaaggatggtaacacaattacagccagatgttagggcttatcttcatggtggggaggtaataaaaagatacataaaggtcgaagaggtggcttatgaatatggatttagtgttgaagaaactgaatatatagctaaggctgcaagttctttatataagcttgcccgtatttatttggtaaaaaaggaaaggtttgatgagtttatgaaacacatatataaagtgccgggaacaaataagcagataatcaaaaagtttgcgaaaattggagaagcttcaattatatacagtattggcagacatagatttatcgagttggctagagcagcaggtgcaacatataaaataaatgagggaacagggggggctgtgctaattaatttagaaatatttgataattatatggagcaattcagacaacctgtaagacctttgaaagagatgttcaagtggctatttaagaagaaaggatgtgcaaaacacatgaataataagttagaagtaatcggcattgatcatggatggtcaatgatgaaaacaatctctcaggtatttgtcacaggtgtaaaggagattacaactactccggcacttttcggtgatgtacttgagtatgaagaaaagttttacaaggtcggaactgtaaggcaggaagtaaaggatacaactgttattttaattctatgaagctagcaatggataatggaatcaggtctattgcatttccttctatatcaacgggagtatttagttttccggttgagttggcagcaaagattgcagtacatacagtaaataggttcttgcaggataatccggattgttttgatctggtggagtgggtgctatttgatactcagactgaatcggtgtatgaatctgaggttgataaaatatattaaagattaatcggtttaagattggttagatctctttgtttaaaccgattattaaaccaattagtactcaaactgctatataataggggttatgattggttaaatagggtcaaattcaaccaatttgaaaaaaatgtcctatttcgtccataaatagtatgtatatggtatactagctaatagtaatgcggtttcaaccgacattacatattattatgagaaattaatgcaaaggagttacaatcaaatggataacaatgaagtagtaacagaagaagtggcagcagttgttgaaaataatacagggattgagattgagccattatttgaggaatatgttgattttgacacattttcaaagtcagacttccgtgttgtaaaggtaaaaaattgtgaggcagtacctaagagtaagaaacttcttagatttaaacttgatgatggtacagagaatgaaagaactattctttcaggagtacatgctttttatgagccagaggaacttgttggaaagacattattggcaatcgtaaatcttccaccacgttctatgatgggaatagattcatgtggtatgcttctttctgcaattcacaatgtaaatggagaagaaaaactgaatctggtaatgttagatgatgcaattccagcaggtgcaaaattgtattaagagtataaatgtcacatggttgttaataactgtgtggcattttatcgttgttgttgataagaatgtgaaaagcaggaggaactacggagagaggtaaaacatataaggttattatgtgactttgatgataaagtagcatatatcattggttatgttacatacaaatgaggttgcagatattagtgaaagaatgattgagtagaataaattattagtattttattaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtggaatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagcccgatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatttggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatggaacgacctttcaaaaaacagttgatttagaagttaactgtttttgaaaggccgtttttgctatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatattgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagtatttcctatgttagcagtatatgcataccatgcttattgtcattatgaaaaaaacgaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattttgaagaaagaggcgtttgatcagaaaggacttatttatggaatgggacatgctgtatattctatttccgatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagttttttttaaagagcatcaatgttgaaagtatatttgaatttgtcgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacgtaccttgttttgacgaacaaggcaattgaattaagtaattgtcagaaagaaaaaatgatagaagcttatgaaaaaatcatatcgaatatacaagaagatgacctggaagttacacggtgtacattgagaaaaatccgacagcttatggaagaaataaaatagtgattaatacaacggagtaagaaaagctccttcatatattagaataaaaatatgactgtttctttaaaaagaagcctgtcatatttttttatgaaaaataaattttgttgaggttaaattgagattgactttgtattgtatcagtatgaaataaaaaggaatcaggtgatgtacaatgaaaaagtataaaatatgtaaaatccttcttgttatactggcaatttttttatgtatggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccatggaagatgatgggtagaatgcatgataaatatttgattgcagatggaaagagatatattcttgggggaagaaatacatacaattatttcctgggtgattttccgggacataagaactatgacagagacgtgttagtagtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgattcagatttttctatcatgacaaattcagttgcaaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaggtcaaaagtgcatcggatggagcactggcattagaaatattggataaagagtatattgatctgatcatttccgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagttggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcactcgtattttcaacagtcatatctgcgttattatttgcttttttgaatcatttttttaatctgcctggtagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctgatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagtccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcaaatttgttgtagagcttccaatacagaaagatgagaccatataagtttaagaaaaacagatagaggaggaattacatgacattttatcaggagttgcagttaaatcaggcaggttctaaaaacctgttgaaaaagagtgaaacactaaaagaaaaattatatcatatgtgggtatatctggtgaagatagctgctacaatggcattttgttttttctttgttagtattttcagtatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcaaatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtcagcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctacagagacttatggactacaaggagcggttagtcttagagtgattcaaaatgtttttggtgttgtgtttgctttagcattttgtgttatattttattggtttatgtctaaaaaaaaggaaagtgatgtgaccgtacatgcagagtgaagtgaatcaggaagaaaatttgaatagaattattacggttcctaatcttctttctttttttcggctttgtctgattccggtaattatatggagttattgtgtaaagaaaaatcctctgttagctggtgaaatcttattgctgtctggtcttacggagcttgctgatggatatatcgcaagaagattccataggattagtaatttaggaaaaatacttgatccggtggctgataagctgacacaggcagcgatgttaatctgtctgtttactcgttttccgcatatgcttcttttaatcgtaataatggcaggtaaggagctgtatatggtagtcagtggatgtcttgtgatacgaaagacaggaaaagtacatggtgcagactggcatggaaagatagtaacctttttattatatggaactgcagcggtgcatattatatggttccaaattacaccgatggtatcagatctgttgattggtttgtgcgctataatgatggtcatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaattttagatagaaaataaatcattcaatgtcatttagataaggttttttatgacaaaaagacagattgcttatctgccttataatgcagtatgatggtaacgagatttatgcaacccgatacatgaaatccctatttctctttggacggaggtggataggatattttcgattgtacttgacaggtgtcagatacttttgtatgagaagcatggactctgtttcgttaccatcgtgtttgagatatgccctgcatatgtttactgcatttgaaacggatttactctgcatctggagcataaactgaatatactcgcggaaagaaagtttgcggttcctggtaaaatcactttccggattacggcagaacatggagtgaatttcatcgagttctgtgatgcagttgtcgagtgtggattttaaattagataagaaaaaatcagccataatgagcctccttgaaatatgtttataatcaaggcttgcgcaacatatattggcttacttgtcaactgttttttgtaatatttttaaagtttttaggcataaaaacagtggctttctatgacagaaaaccactaaaatgatgcttaactgaatggcattgctttatcaccactttgaaaatggttgttttatgacggatagtcagacagttttggatataagagatgatctgggagcaatcatgaatgaatgcagggaagtgaccgaaaagtaccgcacaggacggagtgcatatttacggctcggacagttgtttatgagattgtttgcaggactattatagcagaaagaagaggtgttcgatatgtgtacagcagcaacttacaaaacaaaagatttttatatgggcagaacgcttgattatgaattttcctatggggaacagatcacgataacgccaagaaattacgaatttgatttccggtttgccgggaagataaaaagccattatgctttgatcggaatggcatttgttgcaggaggttatccgctttattatgatgctgttaatgaaaaaggccttggaatggcaggtcttaattttgtcggcaatgcggcatatgaagaggctttgccggaagatgaaacagaagtcagccaagtggcacagttcgagttcatcccatggatccttacacagtgtgctactgtagcagaggtgagagagaagctggcagcaatgagactgacaggcacagcattcagtgaacagctgccgacagcacagcttcactggatcattgcagacaaagactcctgtatcgttgttgagtctatgaaggatgggctgcatgtatatgataatccggtaggagtgcttaccaataatccaccattcccgagtcagatgtttgcactgaataattatgccggagtatccagaaaacagccggagagtacttttgcaggagtattacagcttgatgcatatagcagaggaatggggggaatgggaatacctggagatctttccagccagtcaagatttgtgaaagttgcctttacaaaattaaattcgatctccggtgaagaagaggatgagagtgtaagccagttcttccatatcttaggatccgtagatcagcagcgtggatgttgtgaggtgacagaaggcaaatatgagatcacgatatacacgtcctgttgtaatacagcaaaaggtatttattattatacgacttatgataatcatcagatcacagcggttgacatgcatgcggaaaatctggattcagatcagctgatctgttatccgcttctgtccaagggcgaagtcagatggcagaataaataatacgaaaatgcacggagaaagcatatcgcagaacaacaggaggaagaccatgaaagaagttaaaacaccgaaaaaaccactggcatattattatgggattgtgttaatagtgctgatcgtatttaatctggttgtcacaccaatccttatggagcatcaggtaaaggaaacggattatggaacttttttgagcatgatcgagaagaagaatattggtgaagtagaagttaatgacaatcagatcatctttacagataaagatcaaaaaaatatttataaaacaggtctgatgaacgatccgaacctgacggacaggctatatgaatgtggagcagtattcgcaaaagatatcgataagcagatgtcaccgatcatcagcttcttgctgaccggggttttgccattgatcctttttatcgcactgggaaattatatggcgaagaaactgatggagcatgccggaggaaaaaattcgatggcttttggaatgggaaaaagcaatgcgaagatttatgtgcaatccagtgagggaatccgtttttcagacgttgcaggagaagatgaggcgaaagaaaacctttcagagatcgttgattatcttcacaatccgaagaagtataccgatgtaggtgcgtctatgccaaaaggtgtccttcttgtaggacctccgggaaccggcaaaacaatgcttgcaaaagcagtggcgggtgaatcaaatgtaccatttttctcaatgtccggatcagaatttgttgagatgtttgtcggtatgggagcttccaaagttcgagatcttttcggacaggcaaaggaaaaggcaccatgtatcgtgtttattgatgaaattgatgccattggtaaaaagcgtgacggacaaatgggcggaaatgatgagagggagcagaccttaaaccagcttcttacagagatggacggatttgaaggaaataatggtgtcatcattcttgctgcaacgaaccgtccggagtcgttagatccggcacttacacgtccgggacgttttgacagacgtgtgccggttgaactgccggatcttgcaggccgtgaagcaattttaaaggttcatgcaaagaagataaaagcatctgatgatgttgacctgcatacgattgcgcgtatggcatcgggggcatccggtgcggagcttgccaatattataaatgaagcagcattacgtgctgtccgtagtggaaggaccgttgtaaatgaatctgatctcgaagaaagtatagaagtggttattgcaggatatcagaagaagaatgcggttctttcagatcaagagaagaaggttgttgcatatcatgagataggacacgctctggtagctgcattacagagtcattcagctccggtccagaagattacgatcatcccgcgtacctcaggtgcactcggctacactatgcaggttgagcagggtgataaatatctgatgacgaaaaaagaacttgagaataagattgctacatttacaggcggacgtgcggcagaggagatcgtatttggtgagatcacgaccggagcctccaatgatatcgaacaggcaacaaaaattgcaagagcgatgatcacccgctacggcatgacagatgaattcgacatggtggcaatggaaaacgtgaccaaccagtatcttggcggcgatacgtctctttcctgttctgcagatacacagaaggaaattgatgaaaaagtcgtgcagctcgtaaaagcagagcatgaaaaagcaagaaaaatccttgctgaaaacagggaaaaactggacgaactggctatgtacctgtatgagaaggaaacaattacaggtgacgaatttatggatattttagacagaaaataatgtagttaattagataatcaatgtcatttagataagaaaaatagttagtagttctgaaaaatggaattattttatataaaggagcggacaaattctcatttacagggagcggaagattgagctggataaaatactcggctcaatcttccacatggaatacatcttcgaccagcatattaaagtactttgatatccgcagcataaattcggcagatggggtgctgtccccacgttctatcctgccgaccgttttggtgctgtatccgatagcagcggcaaggtcatcctggtaaatgccacgctgttcccggatttctctgatattattagtaaccgccataaaaatcccttctttcagttctatagatattttcttattttcaattatgcaaaataatgtgtccaataaaaaggacttgcaattttatcagcaatgtcctgtgatagcagaagcatcagattttccaagaacttttccaaatatgtctaagcggtcgttttctccaaccttgataggtgcatacttttcattaagcgagataaggaaaattccgtctttatcgttttgtaatttcttgatgtaggcttctccgtttagagcgaagatgccgatttctccattagcaacagattccagttgtaatacccatgcaatctgaccatcgtggaattcaggttccatactgtcaccactaatgcggacaccgaaagtagtatcttccggcaggatagattcatctatgcgtacagtctctttcggtccgtctacaaggaagttaccggttccggctgatacggcattttcaaaaatatcaatgctacggaatggaattatcttagcagtctgcttttcatacattccggatgcgtggagcagattgatataatccatagccttttccctgccttcatcagtaagtgaggagaaaggatcagtaggatttactccaaaatatgcctcatacatgttagtaataccaaggattctacacactttgtaaaatatggtaacgcttggttcagcaagatttctctcccagttggatatggctttataggaaatggtaatgccttcctttgccagttcatcagcgagatcctgttggagcaagcctttcttttttctatatgatgaaatgatttctccgattgagtacatacatacgcctcttttctttcattttgttgatttcaaatgtctcttttcactccatagtatatagcaatagtgccaattattcaagttaaaaatccaatataatgagaaaaatgacacatgtgtccgttgacagtcgattattcttggggttatactatgccctgtaagaaacattactcatatacttggactaagagtcaaattggaaggagtaagcgctatttaacaaaagatagatcagatatgtgttattcagatgaatggaagttgattgtacccaaaagcttgtattacacaaaaatagatgcacagattgactgaccaattatttagtattgatgtacatttattcttttgctcctgcaaatttcattgttttacagacggaaacaagagaattgcgatcacgttgactgcagatttcttactgagaaatggatacatgggaattgcaaatgtgtatttcagagaaatggaaaatataagttatcatgtggcagccgggcacatagatgaggagcttttaaccgagctgatgactgctatattagataatacttatgataatgatgaagcattaaagttaaaattatttaatgccatttctgttgaagagcagttttacgaatagttttggtcccgacattaatgtcgggaccaaaactagtttgcaaagggcagacagggaagctcttcaagaaactatgatgtattaggaagagaactgtttacaccggatgaagtcagaaagctggataacaaaaagtgtattatctttatccgtggttttgatcctatcatggataatataagttcataccattcaatcatccgatgtttaatcagacagcagatggcaagggagagccttatgttcatcagataaggggagcagagaatctcatcggtccaccatttgagattctttcagacaaggcagttaagtattatgaaaaattaagggataagggagagaatgtatatatagactctcttacctatgagcagtttatgatgcttggtgatgcggaattaagcagaagattctccatgcaggatgaaacagaacagaaagcaaagattgacagggagcagtcgaatgagcttgagtatgtcgatgaatcgcagaagtctgatgctgcagaaagtgccaacgcttctaatggaagtgctggtgctaagcctgtaaggaatcctgagagggaaaagcctaagtgggaggatactatcacaaactgaatgttgcattggtcatatacgccggagcagaaagaggaagtgaagaaagctcttgctgcaggcgttcccaaagcaacgattcttacttacttctatccagaggtaactgtggagaagatgagttcatatcggaagaagcagtaaatgttatcgcataggcatgtttactatggtataatgtgcctatgtgagaaaaattattatttagaacttatttgcttatatgataagcagaatggaggctttgcgagatgaaagtaatcattataaatggaagtgcaagaaaaggaaacactcttacagcgattgaggcttttgtaaaaggagcatctgaaaaaaacgaaattgaaatcattgaacctgacaaacttaatattgcaccatgcaagggctgtggtgcctgtcaatgttctaagggatgtgtagataaggatgatacaaatcctacaattgataaaattgctgccgcagatatgatcctttttgcaacaccggtttattggtggggaatgtcagcacaattgaaacttatcattgataagtgttattgccgtggaatgcagttaaaaaataaaaaagttggcacgattgttgtaggcggttctccagttgacagtatccagtatgagttgattgataagcagtttgactgtatggcaaaatatctttcatgggatttgcttttccagaagtcatattatgcaacagcaaaggatgagctttctaaaaatcaggatgctatgaaagagcttgaggatattggaaaagatttataaagcttgtataatgaaagtgacaaaacggttttccttcatgctggtctccttctgtttattcccggtaaatctgtgcaaaccggaaatttctgatgaataacatggtgcaggatcgttttcgattattatattttactgtgagattgtgatattagcaatagtgaaatggggcagagaagagttgaaaaggcagacggataagaaacaaagataaaatagtaaaaatagaatagaacaaagaaagaatatggagataaaacagaaaggaatagacaatgaatgtaaatcctataacaagattggattatccagatctggacgtgatccgcgtagaagacacctattatatggtatccacaaccatgcattttatgccgggctgtgagattctgcagtcttttgatctggtgcactgggagcatgtgacttatgtctatgagacgttggatcatacggatgcgcagcaactgaaaaacggtcagaatatttacggacagggcatgtgggcagcttccctgcgctatcatgaaggccgattttgtatctgctttgtggcaaatgatacccgtaagacttatttgtatacttcggaaaaaatagatggtccatggaaaaagcagctgatagaaggcttttatcatgacggctctttattatttgatgaggatggcagaaactatattgtatatggaaatgatgaaatctggattacagaattgaatgaagatttgactgcaccaaagaaggacggattacatcgtcttttagtcagtgatcataagaacccggagctaggctatgagggttctcatattcaaaaaataaacggctattattatatttttctgattcattcccggagagaccgctggatgcggacggaagcatgcttttacagtgattctctggaaggagaattcacgggtggagatgtactttgtgatgatcgtggatattgtggacagggcgtggcacagggaggaatagtggatacgccggatggaaagtggtatgcaatgctgtttcaggatttcggagcagttggacggattcctattctgcttccggttacctggaaggatcattttccgttttttggacagaacggacatgtgccggaagaaatagaggttcacagtaccagaccaggatatatttatcagccattagtgggaagtgatgatttctgtaatgggctgcttccgcgctggcagtttaatcatgatccagatccacggtactatcatctggatgcattgcagggaacctatacaattacaacacgggaagtttgtacagagcttacacaggcagtaaatacgcttacgcaaaggatgagttatccgtcctgcgcagctgaggttactgttgatgcttctgcattgaaagagggcgatgtcgcaggtttgtgtgcgttgcagagctgttatgctgcagttggcattacaaaacatcatggaaaatatgaagtccttatgctggataaaaaagaagatggtatattggatatgacggaaggaactattgttgaatcacaccagatggattttcgtcttgaagcagatttctgtaacatgaaggatgaagcacgctgctattaccgggtaaataagggagactggctacccatcggaaccgtgcataagctgtacttcaaactggatcattttactggttgccggtttggtctgttctgttatgcggcagaggaaacaggaggaagtgcctgcttccgggattttaagtattatgatgttgatgaaatctcataaagatagaactgcataaaataagtgtcggaatttactcaaatttttcctactttggacattggtttttacaacggtattgtatagtgaagcagaggaaaaacaaaacatgtttcagagaggagaaatgattatgagaattaagagtatgatgaagggtatgcttgctgttgtaatggcaatgtctatggcagcatgctccggagcacctgcagcagaccagacttcttctgagtcaccgtcaccggcacagacagaaagtacagcagcaacagagcaggaaacaatcgtaacagaagtatctgcagaaacgcagacgcaagaagaaacagcaaaagcaccgaaatatgttttctgtttattggtgatggtatgagctatccccagtttcaggcagcatctgactatcttggagcaatagcagatgaagattatgtcaaggcacttccgagcaatagctatgaagaccgtggaggagcagtactggacggaccggaagcaggatacaaggttacctatacacaggctgatgcagaagcggttaaagctcactgaatctatcgtggggcttcttactatgattgcaggaggcggtattatatattaccttgtctgcaagagatggtcagatgtctttcttatgtctctgatctttgcagctatcatggctcttttgctggctgtcataacagtgcaggattggtgtgatatgctgattgaaaaaattggcgcactctgaaatccgtatacattaagggtttgagcatgtctcgaacccttaaatgcttttataatatcttgtgtttctatttgacgtgtgttaatctttacttgaaaaaggcataataagttaaatatgagacattgtttatgcatgtttatctttgcttatgaaagtgagcatcggtaaactctcaagaacaaggaatcaaatttaatctatcatgtctggcttattcagcgtacccgggatacgtggattttctgccagactatctttatgccttttagtataaatactaggaggtctttttttatggacgagaaagaaatcaaatttatccaagatcaaattggatacacgttcaaaaaccaggagctgcttgttcaagcatttactcgtcgctcctattcaatggaaaatggaggacaggataatgaggtccttgaatttatcggagacaaggcattggattttgttgtcgtgaagcagctctccgaggaattcggccattattcaaagaagtatcagaactgggaaaagtggggtaagaccgaggaaacgggaacctttatttctgatttggatgagggagaattaactgagattaagaagcaattggttcaaaagaacactcttgcagatgcaatcgacaacttagggatagcctactatctgataatgggaaaaggagatgtcgagaaaaacattcaggattcactatcggttaaagaggatctgtttgaagcgattcttggtgcgatagccttggattcaaattgggatattgaagcattacaggatagcatgaatgttatgctgaatccaggcgagctcatgtttgatgaagatgtaaactatgtggctgagatacaagcttggtcatcggctaattcaggaaacattccacttcactgtttctatcctacttccatgcagggtacatggtatatgccaaggcatcatatgtgtatatatggaaaagcggagcaggatacgcactttgcgtgtgaagttctaataccgggaattgattatcatttcgtcggatacggcagatcaaagaatctggccaggatggacgcatcgagattggcgtatgaatatctgaaagatgaggatatgctcttttctattagagatgagattgatgatccgaattataatgattccatcgggcagttggagatccttgccagaagaggctatttctccatccctcaatatgacttcaaagaaacgcatgacgaagatggtaatccggtttggaattgtaaatgctctataaaagaaaaagatactgtaaccaatggaagatcttcgtctaagaaagatgcgaagaaacaggcagcatatgatatgctgacatttgttttggaggaggaataagccatggcaaaatatgcattcaattatgattccggcgaatatgaatatatagaaagagacggcttcagtatagatcgtggtgaatacgtttataactgggatgacagtgagtatcgccgcgaggaagaagaggaagaagagcgtcgccgggaagaacgaagaatgtggaatgaggattgaccagagggataataaatgaatcatgacattgagaaagcattggataatcttgaaaaaagggcacaggatattcaacactatatgaatattatgagcaaagtaaagacggttaacgttgccgatgatcaagattttcagcgggaatttgactttttttacaaggttagacgaaatgcagaatggcggaaagtattctttgagattttcgaaaggaagaaaaagaagaattgttcctacaaagaaattataacggaactgtacgaaggaaccggacaagttgaggcatcctttgcgagtaagatgctggcatctatagatgagaatatgccaatttgggattcgaaggttcttgatagaattggaattaaatcttcaaataaatgaggacagcaaaaactcgaggaaacaattgagttatatgatgtcattgtacaatggtatagtgatcttaaggcaaacaaggcaagctataacgaatatataacatcctttgatagtcgttttccggattattcatcaatcagcgataccaaaaagattgattttatactgtgggcgatgggcgaagaggaagaggatactattccatctgtttatattcaaaatatggaggccttatcagatgctgcaaagattgcatcccgctccatagaagcatatccgggagttgtttctgcggtaaaacaaattgctgattgtatgaagcagtatcaaggtatctcgcaaacctttatggaaaacgctcgtagaattagtgagactatccgccccatttttgaatatcagcaacagataatggaatccgttcggccagcactagaatcgttaggtaaaacaattgcggctatcactgctacaattcctaaaattgagattccggagtcattttttaagactctaggtaacctaagatatctatatacgttaaaaagcattacatggccactatttcttgaagatgatgaggaattaaaagaaatcattacgggtctatgtggggataaaaaagaaaactatccattggatgaattggctgcatctatctgcaattactataattctgagaaattagataatatagtagacggatggaggaaactattgaaggatgatttagagagattgctgttattggaggaggcagttaatcttcacaactctggatgctattatggtgcgacttctatcatgatgtgtcaagtggatggtctgatttgtgacatttcaaattatacagatgaaaatggcttaatatgctcggaagatgatgagaaggagatttgtgaactctaccggattgattttcagaatcataagaaatttgcgaagacaagcgaaaagcatatgattttgaggttggctgcaatgacagaaaatgctgtcttttattgggaagcaatgactgattacatatacaatgtagtgctaacgagtcatggggaagaatatcgtgatcataacccgctgagaaataaaatctgtcatggcgatcaattggatttcggaacggaggaaaaatcgctaaagagtatttttgtaattgatttgttacttaacctaaaaagcgaaatgcaatggttggctgagcacaaataaatttgataaatgaaaagtctaatcccccagctatgctggggagaatggaatagttggaaacggtgaggataaaaaagaaaaacctcctgtggtatattgagaatggtgtcgcaagccaaactcaacacaggaggtggtccaagtggacaataaaagcatatcacacactagatggaaatgccaatatcacatcgttttcattccccaatatcggaaaaaggtattgtatgggaaggtaagagaggatgtacgtgaaatcttaaatacactatgcaaatataaaaatgtagaaataattgcgggagcagtttgtgtagatcacgtgcatttaagtgtcgcaataccgccgaaattaagtgtctcagattttataggatatttaaagggtaaaagcaccctaatgctatacgatcgtcacccagagttgcagagtaagtgggataaagcattttgggcaagaggatattatgtggaaacaatcggtaatatcacagacgaggcagtacagaagtatataaaagaacaagcagaagaatcgagaaagcgattgacgagatggaaggctatagcgaaatcatcaaggagaatattgagtatgacagccttcttctggctcatccatatgaccaggagatggtggagggaatttttgacctgattctggagacagttttgtctaaaaatggagagattaccatcgcaggagatgtgtatccaaagaatcttgtgaaaagcaaattcctgaagcttaattattctcatgtggagtatgtaattaattgccttggaaagaatactactaagatgcggaatataaaaagttatttacttgccagcttgttcaatgcaggaagtaccataagcagttattatagggctgagataaatcatgatatgccacaatatgctgggtaatcgcgcaacgagaatactatgtgtggttggtgcaaattctgcatcatccattgtaaaagtttaaaaatgcgacaaatcaacaactgtacaaaccattttgaaataaaattaaacttgactttgttggaaactggtattatattaggtttataaaagtgacaaattagtttacatataacccaagttgatttataaaacatggaggcgttgattttgaatctgtattttgaactattgaaaactccagtatttactgtgaaagatgtaaataaatattatgacaatatggacagcgctcgctctgcaatcaagcgattgatgaaggagggaatggtggcgaaaatccgtaacaatatgtatacctgcatcagtggagagacaggggcgccggttgctaatcgatttcagatagcaagcaagattacgccaacctcttatgtgtctcaccataccgctatggaatattacgggataactgatcaggtatattacgatgtctatgttgcatcagaaaccagctttcgagagtttgaatttgatggatatacgtatcgatatgtggcgtcaaaggatatggaaggcgtggaaacgcctgcactaagtggtggaatacgtatcacaaatcgggaacgaactttggtagactgcgtaaaggatatggataaaatagctggaatagaagaagtgatacaggatattggaagtatgaagcgaatgcaggagaaaagagtcttgaaatatttagacctattatcgaatcagttcctataccaaaagatgggatttcttctttctgagtataaggagaagatggggctttcagatgaattctttgatacatgtaagagtcagattggaaagagtaagcgttacctgacgaaggacatgtcgagtggacgatatgttgatgaatggaagcttgtgataccagagaatatttacaatatgaaaaatggggtgatagaagatgccacaatataatagagcagaacttggacgaatggccacagaaagtggttttgtgagggatacttttgaaaaggtgcttcgattgaaggaaatattaaaatttctgaatgaggacaagtccttaagagagcatttactcttgaagggcggaacagcaattaatttaactgtatttaaccttcctcgattatcagtagatatcgatatggattatactcctaatgatacgagagagggtatgcttgaatgccgtgcaaagataacggacataattaaggaatatatggaatcagaagggtatcagttatcggaagcatcaagatttagccatagcttggatgcatttcactataattatcagaacgccggtggtaatagggatatgattaagatagaactcaattattccttgagggcgcatatctttgaaccggtgtacagaagcattcttccatcagcatttgatgatggattgaaaatacgaatggtaaatcctttggaaatatttgcagctaaaggcaatgctctcattacaagagctgcggccagggatttgtatgattggtgcaatatgttgtctgagggtctctttgaagaacagcgtgatttgtttagaaaatgctttttattttatatgacgatttcagcagatacgcttaataaatcatttgacacctcagctattgacacacttgatttcaacaaaatcagaagagatttatttccagtacttaataagaaagataatttccagttggatgagagaaagaagattgcgaagaattacatatcggatctcatggtgttgactactaaagagaaggaatatattgatagattcgaagagaaaaaatacatgccagagttgctttttgaagacgcggagatagttgaaagagtgaagaatcatccaatggcactatggaaatgtaaggagtagattggctatgtatatattttgttccaaggcattagccgatgccttaaatatcaagaaaatgaattacagaaaatgccggtagatgctcaaattaatgaattatatgcctggcatggtcatataacaaagcttaatggaaagaacacgattatcctaatgaatgacagaacgatgtattcactagttttcagaaacagattgccaaggaatgttgataagtttgcagaactaatcaaagaagctatcccttataccatggaagtcggtggttttaataaccttgaaattgataagtatatgtccgggctggggaaaataatatttgcagagaaagcagataggcaaatgacaggtaatcttaccagaatgtttcttgatatggaatacacttgtgacagatggcaggaaaatgaaagtgttcaggcggaacaggcagcatttgaaaataatggaattagacggcaagggaaagaatatgtgaagccatttgagcggatgctggatgaactggataattgaaccatcgcaaaatttgcgacaattcaaactgaagagagtaaaatagtcgatataaaatgtgttagctaactaaatatgtttacagcaggtcgctaagtgccggtggcacttgtttagcgacgaccgaagtggaacgaagacagctgtgctaggctgttctgccgaaggctctgattgtggggaaaattctatggtcagggccttttctattgccttcaagtgcggctgcgggttcatgctgtcaacatatagaaaagtattcgcaacatagaatatttatcttgaaagtattcgcgtattcgaatataattaatatgacatgttgtcgttttatatggaggacatagaatggaatatttaacttcagcagattgtgcaaaaaaatggaatgtttcacagagaagagtggcgatttattgcaaagaaggacgtatagaaggcgctatcatgatgggaagaatgtggatgattcctaaggaagcaaaaaaaccagaggatcctagaaaagcaaaaaagaacatatagcaatgtaacagtgatagagagaaggtgagatattggctgaactgataattgatagaaattattataataaacttgatatagaaggcttttctaagatgatgagctctccttcgtatagctataaattctattggcttgaagcaattgtacagttgatatccgctaatagaacagaagtcacatatgatgaaataatcaataaaatgattgtgaatgcgtggttccctgtccaggaatatcatattcatttaagtggaatctacggggagggagaggtgaaagataatcttgaaaaggctgtatcaagattattcaaactatctgatcttccaagtaacgcggatgaaattcagattattaacaaactaaatgaattttcagatgacaaggaattacacttttataaaacagagcttactaagaatgtgccttataaagctttatctggatttgcaaataaaggaacagagaagattgacttaaatagcagcgcaggaagaatgatagcttattataatagattaagtgggtcagaaatcttgcttccatatacatttaatgatgaaaagagcttgaaaaaggttgtctcattcaatgatggctggattcagatgattcaagataatacggtttctattttaggatggattaagtatgagaaggtaaagtggttacagaacaataacccggaagtcccagggatagtatataaattaactcaagaagatgagaaagcaagaaaacttgaaaatgtaagaaaactgtgggatgcgattttggaaattcgaccagttaaaaatgtatttatggaaggtgacataaatagagaaagctacgctgtggatcactttattccaagaaactttgttatgaatgatgaattgtggaatttgatgcctatggatccgatacagaatatgcagaaaaataagaaacttcctgcatggaacgattattttgagcagtttgcaaataatcaattcataatgtatgaattgattcatgaaaagccaggtctgcaaaaactatacaagcattgttataaagataatttgcactcgatatgggcagtacaggagttatatcggaaaggaaattcaccgtcagagtttataaacatccttgggaaaaatatgcaaccggtatacgattctgcaagaagacaaggttacgagatttggaaggtttcataagggggcgtcataatgaaggtatataacaaattagtacgtgataaaattccagaaataattgaagcagacggtaaggtgtgtaggacacatattttatcaaatgaggaatatatagttgcgcttgaggctaagttgaatgaggaagtggctgagtatcaggctgataaaaatcttgaagagatggcagatgttctggaagtgcttcatgcaatttgcgtggcgagagggtattcattggctgaattagaggctatgagagctaataaggctgaaaagcgcggtggatttaaggagaagatatttttagagtatgtggaggagaaaaggtagatggcagaatgtatatattcaaataatatcaataaatccattttgacatcgggattcactattcctgtagataaatgggatatttttgcaaaatgtttaggggcaaatttgcaaaaaggcgaacgtaaggaaatagttgtatgggttggtcagttaaagtgttcagcctcatatacaaatgttaatttgactggggagaatgcaggaagaactgtatttcaagttagatattcaggggatttggtttcagaattacgaaagattttctcacctaactcagacaattatgatgcagtaggcggaaagctagaagtatactctggaaaagttggcgaactaacatttaaatgtttgcccgctgtaaccgtgaacacaataaatgaagatagtgctgtttcaacaacaccaggtgttatgaatctaaatacagtggtaacaaaaattctgaatgattatgtcccttcaaaaaaagaaacatttgcgggacatcagatgggatcgtttttcaggtcggatataccattagcaatatatgaaaccggaattgtagaatcagctccgtatttgataacaggaagtgtaggccagggaaattgggccatgattccatgggtttgtatattcgaccggaagattacgaccacagccacaaagggcatttacattgtatatctactttctaaggatggaaattctttatatctttcatttaatcagggatgtacagatataaggaaaaataattcgaagaaagatactattcgaatcatgcgtgagaaagccgaagacataagaaaacgaattgattctcgaggatttaatgctgataacaacgcaaaacttggggatggtttgactgagttgggtgaattatatcaggaaggaatgattttctataaggaatataaaaaagggaacgttcctggtgaatcagagttacagaatgacttaagactcatgatggatatttacaaagaatatgttaatggtaaagctgagaatacagagattatagatgtggaagtaggtgaggaacaattgtcaacaaaggatacattagatcagataaagaagtacatagcggcaaaaggctttacttttaatgaaggtcttgttgagaattattacctcagccttaaatcaaagccatttgtaattcttgcaggaactagtggtacaggaaaaactcgtcttgtaagactgtttgctgaagcaattggtgcaacaagccagaatggccgttataaacttgtttctgtaagacctgattggtcagactcatcagatttgttcggccatgtgaacttaaatgataagtttattccaggagcaatcattgattttgttaagcaggcagaactggatagtagaaatccatatttcttatgcttagatgaaatgaatttggcgcgtgtggaatattatttaagtgatattttatcaatcatagaaacaagagaatatgtggatggaaaagttacaacagatccgcttattacagaaaattattatggagcagatattactgcaaaaggaaaatatggtgttgtaagaataccagagaacttatatataattggtactgtaaatatggatgaaacgacattcccattcagtagaaaggttcttgatagggcaaataccattgaattttccaccgtagaattactagcaaattttgattctacgcagggcgaagtaaaagctattttcgcagataacacatttatgaaagctgattatgttttttttaatcagtgtgcttcagacaaggattttgtcgaagatgtttgtatagaacttcaggatattaataagattttggaaaaagcaaatgctcatgttggatatcgtgtaagagatgagattgtattctatatgcttaacaataagaatgcaggtaatcttttgacaagaaatcaggcatttgatcatgaaataatgcagaagattctgcctagaatacaaggaagtagcgcttcagtaaaaataatgttatgcgaattatttaagtattgcgcaggagattatgagagctatcagacggagagtgatgatgtaagtgcgaagatgatggcggctgcaaataaagaaacttgcaaatacaaggaaagtgcaaagaagattgctttcatggtaaggagatttgaagaggatggattcacagcttactggctctaatgagttgctatatgtgcaaactgaaaaagtaagtgtcaccataaaaggaaaggcaacacatcctaacttccaaggaattgagcataaaaacggcgattcatcaattaaggttcattgtgtagatgattttcaaatgactttaagggatggcgatgtaccacggttttcctcaagaaatggggaaatttcaacgggtatatattcaatctatccgatgttttatgagcaacagcagtatgaaattgtaattgaagctgtagatggacataaggttgcgttttggcatgataaccttaatgtgcgtaacaaggtgacacgagcgagtagaaatcatgagattttatctggcgtcatcaattttggaaatgaaattggtttttctgatttagtgatccaaattgatggtgttaattacttgcgccttgttatagaggtttttcctactaaaatcgattatcaaaacgattataagcagattgtcgaagatgtaactaaggaagtttacaatgttgtttttgatttccttaagaaaacatatttaggatatcagcagagcgaaaaggtgaatagtagtccagttgaattctttgcggttataaacaagatatacaaagattttattaaagcggcagataccattatgtcacagcctcatcatgtgctagatacaacacatcaagttttaccaagtcacaaagttaagaagactgatggcagaacgataagatggattaaaaagcatccagatcaagcgaagagagtgaatggagagattcgcattgaaagagcattggctgtaagaaaacaagtttcatatgatacaaaagagaatcagcttacaaaatacatactgctttcaactgcgaggaagttggaatcattcaaaaagaattatcttaaattgcagcgaaaagaagaccaggccgtaatagccaagattgacggaatggtgagagaactaaaccggcgttgtaatactacttttttggctgatgttgaggcaaaagaagcatcctccggtatgtcattagttttctcaatggctccaggatatagggatttgtataaatactatttgatgcttttaagaggattatctattacaggagatgtcttcaatatttctgtaaaagatttggctttattatatgagtattggtgctttatcaagctcaatagcatgatgaaggatcgatatgaattgatttctcaagatatagttaaggttcagggaaatggtttgtttgtatctttggtaaagggctcctcgtcaaaggttaagtatcgtaattcagagaatggagaagtgattacactatcgtacaaccctaagtcaggacaagttccgaccgtggcgcaaaagcccgataatgttctttcacttgagaaaaagacggtaaatcaggttggaaaaaaggttaaatatgaatatgtatttgatgcaaagtatcgcgtaaatcctgcgttggaaggcagtgattattacaatactatttcacatacacctggtcctgaaacggatgatataaatacaatgcatcgttacagagatgcgattgtttatcataatggtgcagatccatacgagagaacaatgtttggggcatatgtgttattcccttatgcaaataaggaagaatatagaaatcacaaattcttcgaaagtattgagaaagtgaacataggcggtttgccatttcttccttcagagacttctatggtacaggatatgcttgatgctttgatagctgattctccagattcggcatttgaaagagcaacattgccaagaggtattgaggacaagcttgccaagattgattggaatcaacgcgatgtgctggttggagcgttgagaaacagagcacagttggatacttgcttaaagtataagttttatcatatcccggcgtcaaagattagggatgcggatttaccaattcattatgtggcaatttatcaatctatcaatatctttgggagagaagcgggaatcaggtactatggtgaggttacaaagacaagtgctgtaaagcgtagagacatacgagagattccaaagaattctgatgaggcatattatcgatttgagattaaggaatggaaagaattaaacatcccattggttgcaaaagaagtcagggatttcccattctttacaaatatgttcttgttgcagcactgtccagatgtgccagatcttcatatcagttcagaggaagaatatcgcctgtacattgaagtacgaagattggcaaatgacgcatcggtcaacgagacggatgctgagcctggtttcaagtatgatgataagacaataattatggagaatggggacattgttgttcttaaggatggaacaaagattgagcaaatttctattgagacttttatgaggaaaccaagggagtcaatgagggtgatagcgaaatagaatattttaaaatagtactaataaaagaaagaatgactacattgttgcttactcccatgaacacgcctttttcttgaatgaaaagtctaatcccccagctatgctggggagaatggaatagttggaaacggtgaggataaaaagaaaaacctcctgtggtatattgagaatggtgtcgcaagccaaactcaacacaggaggtggtccaagtggacaataaaagcatatcacacactagatggaaatgccaatatcacatcgttttcattccccaatatcggaaaaaggtattgtatgggaaggtaagagaggatgtacgtgaaatcttaaatacactatgcaaatataaaaatgtagaaataattgcaggagcagtttgtgtagatcatgtgcatttaagtgtcgcaataccaccgaaattaagtgtctcagattttatgggatatttaaagggtaaaagcaccctaatgctatacgatcgtcacccagagttacagagtaagtgggataaagcagcattttgggcaagaggatattatgtggaaacaatcggtaatatcacagacgaggcagtacagaagtatataaaagaacaagcagaagaatcgagaaaagaagattcaagaagtaccgctttatagcggaccagtaaaaatgcttgtgacaccgccctttggggcgagtagtaacatagccctttggagggcttatagcaaaccaccagttgaactggtggttgctgacttaaaagaaaactatgaaaaatgctggtgttgaaaaataataaattgttgtattatgatgttgataataaaatatggaggtgtatcatgaaagcacataaatattggtcaatcggagcaatagttacaatggttggaactttttatacaggatataaagggttaaaagcagcacacaaatactttgcatttggctctctgatatgcatgattatggcagtctattctggtcataaaatgatttcaggtaataaaagaacaagaaaacaggtggaaaatacaaaagcggaggaatagtaaatgttagagttaggaataaaagcaccggactttgaattgccggatcagaatggagaaatgcataaattaagcgattatgcaggaaaaaaagtgatcttatatttttatccaaaggataatacaccaggatgtacgaagcaggcatgtggcttttctgagcgttatccacagtttactgagaagggagctgttattctcggagtaagcaaggactctgtagcgtctcacaagagatttgaagaaaaatacggactggcatttacgctattagcagatccggatcgtaaagttattgaagcatatgatgtctggaaagaaaagaaaaattatggaaaagtatctattggcgtagtaagaactacatatcttattgatgagcagggaatcattataaaggcaaatgataaagtcaaggcggcagatgatcctgaaaatatgcttaaggaattggcataatgaagattattttatcacctgcaaaaaagatgattgtagataccgataacttagcaccggttgaactgcctgtctatattgataagacagcagaagtattaaactggatgaaaagcaaatcaaaagaagaactgaaagctatctggaaatgtaatgacaagattgcagagcagaactttaacagattggaaaatatggatctttataacaggcttactccggctgttttagcatatgaagggattgcatttcaatatatggcaccatctgtgtttgaaatccagcagtttgagtatttgaaaaatcatttaagaatcttgtctgcgttttatggcattttaaaaccaatggatggtgtgactccttatcgtcttgaaatgcaggcaaaggttggaattggagatgcaaaaaatctgtatgagtactggggagaattgttataccgctcagtaatcgatgacagtaggattatcattaatcttgcatcaaaagaatactcaaaatgtatagaaaagtatctgacatcacaggacagatatattacgattgtattttgtgagttatccggagataaattggtaacaaaaggtacctatgccaagatggctcgtggtgaaatggtcagattcatagcggaaaataatattgaaaatccggtggagattcagaaatttgacagactcggatattcgtttaggtctgatttatcttcagattcagaatatgtatttgaacgcgaaataaaatagttattcaggaaaaagatgctcagtttggaagcttttataataatgagaattattactatttttattgacaacaggatgatagtggtatacaatccttattaagaactaatcctaataaggaggaaaatgacaagtaggagaaataccattcaaaaagatcttgtaagaaataccgtatacgaaatgagaagacacgttacggcaaatgaagtgtatgaatttataaaagaagcatatccaacaattggaaagggaactgtatatagaaatcttgatatattggtagaggaaggtgcattaagaaaggttgaagttccggatggaccgaaccgatttgattttacattgaaaaatcattaccatgtaagatgtataaagtgcggtgaagtttttgatgtggatatggatcaaataccggatttgctggaaagaattcataacactcatggaattgaatttgtggattatgatatttcatttaaaggcatttgcccgaaatgcagggagaaggtaaagaaggaacagcatggatagaaaagcaatgtataagttgagttatggactgtttatattgaccgctaaagaagcagaaaaagataacggatgctctgtaggaaaagaccagttctcagaagcataaatgtattatgataggattataccaatgaaagaagaactaagtatagatatcatcggacttgcaggagcctattcttatgctttggactgtatagaagcagagttggtaaatatcaaaaacaaacatggaaaaagagtggcttatataagtatatgcatggctgaatattggaaaattcaaggtgatgaattacaagatttagccatgtgtgctttactgcatgataatgctttgacacaatatatttcggaagaactgaaaaaggattccgtcattaattgtaaaaaagatttatccgagaaaaaaacaaatcttcattgtatttatggtgaaaaaaatattactaaaattccatttaaaacagatgtgtcaaatgtgattttgtatcatcatgaacatgccgatggaaccggtccttttcaaaaaaagtggaatgaaattccattgtttgcaaggattattcatcttgcagataccattgatattataggaaataatacgggatctggaaataacagttggaattttatatgtcagtaccttttaaaaaatagggatggattattcgattcagaatgtgtgaatgccttttttcatgcattcacacattctgaatcatttatatgtttacgtgataattcttttgaaacgaagctatgggagattatcccaagacaaaaacaggtttttgattggaaaacgtgtaaaaatgtcgcagatttttttgcaaagattgtagattataaatcttcttttacaagcagacattctataggagtggctgaaaaagcagctttttttgctcaatatatcggatatgattctattaatgtgcaaaaaatttatctggctggtgcactgcatgatattgggaagatggcagtaggcaatgaaattttggaaaaaccggataagcttacggatgatgaattttcaaaaatgaagaatcatgctggctatacataccttatattatcagaggttaatgattttgaagaaatacgagactgggcagctttccatcatgaaaagttaaatggaaaagggtatccttttggaaaaaccgcagctgaattaaatgagccggaacgtattatggcatgtattgatatttatcaggcattaaccgaggacagaccatataagaaaggtttatcgcacgaaaaaacgtgtgagatactcgatgacatggcgcagaaaggttttgttgattcggatatttccaagaaaattagggaatgttttggtggaatctaacattaaaacgagaaaatataggaaattcatgagaaatgcatttgcctgttatgaatagtatggaacaggttcataaaacaaataaacggaaggtaggattaatttatgtatgaaatgaaaccagaatattatatcggtatagatatgatagacgaagaacacaagcagttatttaaatatgcagatgaggcatatgaactgcttcttgatgagtttacaccggataaatatgataggattgatataatattagaaaatctccgaaattatacagtaaaacactttagtgatgaagagcagtatatggaatctattaattataagaagatatttacacagaaagttcaacatcaggaatttatacataaacttgatgaatttatggaacatcacaatgatgaggtagaagatcaagatgaacagattatgggaattttaaaatatctcacagagtggttagttaatcacattctgtatgtcgatggtcaaattccaaaaggctgatatagtaagaaaggctgttattttttagagtagcagccttttttattttgaatataaaatatgacacatcctatacttcctaggtgtcacgccatacttctgtttaaacgccttgataaaatggctgcagtcacaaaatcctgtctcctggctgatataagttaggtcaaaatctgtgaattgcaataagtcctccgctttttgcagtcttactgtgagaaccatctccttgcaggtctgcccatagtactccttgaatattgcggcaaaatatgaataactcatatgaaatttttccgccagctccgccaccgagagagcttcctggtagtgctgtgaaatgtactcagatacctctgtaaatttttcgcttaatacagtttcttttttccttttttttatctgaaagccttcctgcttccagacacgaagaatttctgccataagaagacaataattcgaatgcataataatgtcataaccaaattgcttttcttctaacgtcttcactgatccctgaatcagctgcttcaatttttcctgattaaatttctctttcgaaaaataaaccgatagcttctgctccactgctgccatggcgatcagactcgaaatcggtggaagcgccgaaccggatatattcagatgtaccggatcaaatttcagaacatagtagcggattggaagttgtcctgctgaataaattgcatgagccatctgcggataaaatacgattagatctcccggttccaatacataattctcttctcctgcctctacatacgcctttccctccaccatgtaaagaatctccacaaaataatgccaatgtggaagaattggaaacatctcagatgtctgtgcatcaaataaaaaggcttcatatggtttgtttaatttgtctgagcattcaaaataaggtttcacagattatctccatcatagatttttacaattttgtaatagattcattatatcatatcttttttctacatgatatactttcagcagaaaacatccagaaactatataattcgaaagacaggagatttttactaaaatgaaaattcaaaatcaacttggatatattaaaggaattacatttgccccatttcacaaacgtggttctctttctacacagactgcacgtgatagttttgattatatgatagaacacacggctgctgatttcgtaatccttgctcctgtagggctacaggagcacgcacactcagaagagatttgttacacttccagtgccacattctcagatgaagaattaatcaatatgatacgttatgcaaaaagcaagagcatccgtgttgccctgaaacctaccgttaattgtaaaaacggtgtctggcgcgcttacatcagtttctttgaaaaagatgttccatgtgaaccgaaatgggaaaactggtttgcctcttacacagaattccagacatactatgccaaaattgcagaagccgaacaatgtgatctttttattgcaggatgtgagatggtaatgacggaacaccgcagtgaagaatggagaaacgtaatcgctgcgatccgaaactattaccacggacctgtttcctataataccgataaatatcaggaagaaaatgtaacctggtgggattgtgtcgacatgatctcctccagcggatattatccgattgatcagtgggaacaggaacttgaccgtattgaaagggtcgttcagaagttcaagaaaccatttttcttcgctgaagcaggatgcatgtccagaaaaggttcctcaatggtgcctaacaattgggcaaatcagggagctttacgtctggaggaacaaccagactggtatcgagctatgttcgaggcctgcgcaaaacgctcatgggtaaatggttttgccatgtgggaatgggcaccggttcttccttccagaagtactgcggcaagagataccagctacgaaatctgcaacaaaccggtacaggaggttattaaagactactatgggagagacaaaagaaaataacatacaacaaacttcagaacaggatctctggcaggaagaagctgccatgatgcacatcttcagccggaacagaaaaaataacctgcgcacgcttctttctcttttcaagggacattatggcgcgctggctggttccattttctttttcattatcaagcattccccaacctgggttcttccaatcgtcacagctaatattatcaatgcagtgacagaccacaacgggaatattaccaaaattctgattctgaataccatccttatgattgtatttctggtacagaacataccaaccaactacatccatacctggctctatgccaaaacggtacgaacagtagagaaagaactgcgcgaagccctagtctgcaagcttcagcaattgtcgatcacctatcacaaggaaatgcagtccggaaggcttcagtcgaagatcatgcgagatgtagaacagatacaaaatcttgcatctcagatctttatctctcttttgactatcattctgaacattggtgtatccttcggagtggtcatcttcaaaagccggatcgtatttcttttcttcctctgcacgataccggtttctgttttgatcattgttggttttaaaggaaaaatcaaaacccataaccgtgctttccgtaaagaaatggaagaaacttctgcaaaagtaatggaaatggttgaaatgattcctgtaacgaaagctcacgctctggaagatcaggaagcccgtaaaatgagtgaacagcttcgtaaagttgctgaaaaagggcttcagcttgatatgattcagacatacttttcttcaatcagctgggttgcatttcagatctttcaggtattctgtcttgcatttacagcctacattgcatggaaaggaatcatcggtgtcggagatatcaccttataccagacttatttttccagcatcgtcgctcagattgcaggtattgtgactttgctgccaatcattgcgaaaggcctggaatccgttgaatcgattggtgatgtgctttgtgcaaatgatattgaggacaaccgtaggaagaaaaaagtagttgatctgaaaggtgagattacatttcaggatgtatcttttacttataaaggcgatgaaaaaccggtattaagtcatctgaacttcaagattcagccgggggaaacagttgcctttgccggttgttccggctctggaaaaacaacaatcctcaatcttgccatcggtttcctgaaagctgacagcggacaggtattggttgatggaaatgacctgatggaactggatctgcacagctaccgaaagcagattgccgtcgttccacaacagtccattctcttcaccggaactttccgcgagaatatcacctatggatctgaatccatctccgaggaacagttatggaatgtcatccgtgcagccaacctggaagaagttgtccagaaactgcctgatggtctggacacgatgatcacagaacatggggaaaatctttccggcggacaacggcagcgcatctccattgcccgcgcatttttacggaatccgaagatcctgattctggatgaggcaacttctgcgcttgacagcatctctgaaaagaagattcaggattcaatccagaaacttgtgaaaggacgtaccacactgatcgtagcccaccgtctgtctaccattcgcaatgctgaccggattgctgtgattgaaaaaggaaatgttctggaatgtggctcttacgaagaattgatagagaaaaaaggcgcattttatcggatggagaaaatgtaaaaaatcagtagctggttagttcagaaacctgtctgcggaattgatctggaaagagtagaaagaaaatagctggacagatgcagaggcacagagcaacatactaaccttgattaaaaatacttgattttacagtgttttggggatgttacagtagatttttaccaacgatttaccaaagctatttgagtaggggataaattactcaggatcagcccgcatttgaaagaaggtgaccacaacgaaactgtttaagaaaaaaattcccgaacagacttatgataaagccagccaaaagccggtgattaaggcgagcatctgcaacggcgagcagattgccggtttcaaggatcttcatacgggaaagatcgaggaagtgatgctgattaaggggccggcggatttggaacggtttaagaaaatgtatggcattgaggatgagatcggaaaggagtattgatatggcgaaaaggaattgcgggaactaaacgaggagtattgcagctgggagtacatggaagtgtcggaagattacagataaaaagtatggacagccggaatatggagtaccggacataagacagagcgcggcagggacagctgcgcatggcagaaggtaagagaagggaagactgccggcggaacatgcagagaggacagggatacgggatgaacagtatttttcacagaatcagcgttagaaaatatcagaacagggacgtggagcaggagaaaatcgagctgatgttaaaagcggcgatggctgctccgtccgcatgtaatcagcagccgtgggaattttatgtggtgaaggacaaggcggtgatcgagcggctgtcagaggcgtcgccctatgcaaaatgtgcgaaggacgcgccggtcgtgtttgtgccgtgcttccggtctaaggggattgcgccggaatattttaatatcgatatgagcgcggcggtggagaaccttctgctggaggcggacgagcttgggcttggcgcggtctggatgggaatttcgccggacgaaggcagaatgaaagcggtgcaggaagtgctggatattcccgaggatcttcatgcatttgcgctggttccctgcggttacccggcagaggagagagcgcaggaagaccggtatgaggagagcagagtgcactatattatgaactgataagccaatattccgagagcagaaggttggcaaacaaagatatcacattataaaaacggggcggcagggaagcgtttctctgccgccccgttttcgtatatttatgaaaaataagagggagaacaagccccctgcttgccgacgctttagcggtgcagctcctgacagcgtttccggtactcggacggtgtaacatccgcgacttcccggaagacccggttaaaatgtgtcagattggaaaacccggtttctctggcgacttcggtgacattccggtccgtttccatgaagagccgcttggcgttcatgatgcgggtctgcttgatatactccacgatcgtgcgcttggtacttttcttgaattcccggcagaggtaatattcgctgacataaaaacgctcggagaggtccttgagtgtgatatcttctgcataatggttatggatatactgaatcactttggtaacccgggtctcgcggaggatgccggtgctctcctgattcatgcgcagaagctgcaccataatcaggttcaaaagagactgcatacattcgtcgtggcagtccagatgcgaatgctgctcctcttccatggcatagatgatgcgccgcagctggtgaagctcctgactgtcaggacggtaaaccacctgcgagtggagaagcttatgaagaagatccgccgaggtgatcgttttcgggcggaaatacagcaccacccgcgaaaatgccatatcctggtcaccgtaggaacggtgcatcgtctgtggagggaagagaatacagtccccggcctgaagcttgaagagcttgtcatccatcagatgatagcgctccccgctgtcgagaaaatacagctcaaaataatcgtgatagtgagactgtgacatattgtcattgacgccagttacctgggcgatggcgcaggctgcaccggctgccatacttgtctgtgcaacatcaatcataaggcacctcatagaaaataaaaaactctgtttctatggaaattataaagcaaaaacgcaacaagtgcaagatatgtaaaaaaaagtgcgattttgaacaaagtctgtatagttattgaacctgagtttttgtaagatgatgacagaaggaaaacagatctgaatgaaccggatatagacaataagaaaaagagttacaaaaccaaaggaggaaaactcgtgaaagtatgttacaaagcaggtgctgtcacagcacagaatcattattattcgattgctgcagatgcagtggagattcgtgtatggttccttacggatgatatcatccgtatccgggcgggctttgacggagactgggatgaagcatcctacagtctggtaacaaccgcgtgggaatcccgcacagatgaactgatgaaggattaccggaagcggattaacgtagcggaagctgcactggtggatggtgagaccagggcagtgattaccggaaagaagctccgtgtggaagtggaaaaagatccattccgtatctgtgtctatgatgcagaaggaaccatgcttcatgcggatattccggagcttgcgtaccgtgaggattctaacaggcgccgcattcataccagccagatcgaggatgacgattatttttacggatttggtgaaaaaggcggcgagatcaataaagcagaaaaatatatgaacatggctcccggagatgcgatgggatacaatgcgaaggagacagattccctgtacaagcatattccgttctatatcaagctgcagcgcagcacgaaaaaagctgtaggatatttctaccacagcacggcagaatgtgacttcaatatgggacgcgagaagcggaattactggcatcgttattcttccttccgtgcagatgccggcgatgtggatttattcctgatcgcgggaccgtcgatcggggaggtcgttgagcgctacaccgatctgacaggaaagtccattcttcttccgaaggctgcattcggatatctgggatcgtcgatgtactatccggaactgccggagaactgtgacgatgcaattctggaattcattgacaccaccagggaagagggcattccggtggatggtttccagctttcttccggatattgtgccgttgagacagagcagggcatcaagagatgcagctttacctggaattataaaagattcaaggacccggcggactggtttgcaaagatgaagcaggcgggcatcgttgtctcaccgaatgtaaagccgggaatgcttctcgttcatccgcttttggaggagatgaaggaaaagaagatgttcgtcctcgacagcacaacggatgagccgggaatcggtacatggtggggtggaaccggaattttcgtcgactttaccaaagaagagaaccgcaagaactggaaagagtatctgaagcagggtctgatccagtatggctgcgagtctgtatggaacgataactgtgaatacgattccatggtagacaaggatgccagagtatattttgagggaaaaggcagcacgatcggtacgatgaagccggttatgagcaacctgatgtgccagctgtccaatgaagcggtaacggagtacaatccatcggttcgcccgttttccgtgtgccggtccggacatgccggaatccagcgatacgcacaggtgtgggcaggcgataacctgacctgctgggatacgttaaaatacaatatcgcaaccattctcggaatgggactctccggagtcgcaaaccacggctgcgatgtcggaggtttctatggtgtttctccggaaccggagcttttcgtccgctgggtgcagaacggtatctttatgccgagattttccatccactcgaccaacaccgacaatacggtaacggaaccgtggatgtacacggacaagaagcagtatatccgggacgcaatcaagttccgctaccgcatgattccgtatctgtattctctggagagcagagcgcatgagaccggtcttccgattatggagccgatgtttatggcatttcagaatgacccgaagacctacaatgaaggcgtagattttatgtggggcgattcactcctggtagctaatgttgtggaaaaaggagcaaagaccagaagcatttacctgccgcagacgggggatgagaacgttcgtttctatgatttttataccagagaagagtatgcgcagggacagacgatcgaggtgccggtcgatatcagttccatcccgctttacatcaagagcggtgcgattattccgatggcggagaatcagatctacaacctgatgcatgagacggtaaccggacttcatattcttatggcgccggacgtagattctgaatttaccgtatatgacgatgacggaaagaccaatgagtaccagaacggggcatatcttaagacccatattaaagtgacggcaggagtcagaacctgtgtggacttcacttatgaaggaaattatgagaataccgtggacacgatgtatctggatgtggtacacagggaaaaagcgccgttctatgttcagattgacggtgtggaagttccgcattttcttcacagacgcaaatttgaagaggcgcagaccggctggtattacagccagagcttaaagtcggtacaggtgaagtacccgaatccgaaaaaggatcatcatgtgatgatttcctttgaggtattcgatatgattggaatgtaatttaaattagaataaaaaaggaaaaggagaacaaaagcaatgaaaaagaacatcgccctcattttggcggcagcgctcgttctgccgaccgtaattgcggcaggcggctgtggcgcaaactccggagtttccagcagtgcagaggcaacggcagagaatccgatggtattgactctggcacacggtctttccgagacgcacaccgtacatattgccatgacgcagtttgcggatgaggtaaaagagaagaccgacggacgcatcattatcaacattttcccgaacggacagcttggttctgagacagagaacttagagcagttgcaggcaggcgtaatcgcaatgaccaaggtttccgcaccgggtcttgccacctataacgaagcttacaatacgttcggccttccgtacattttcaatgataccgaagacttctacgacattatggattctgaggacatgcaggatttcttcctttcctccgaggaagacggatttgtgacgattacctactttacgtccggcgcccgttccttctacaccaaagacaaggcaatccgtgtgccggaagatttaaagggattaaaaatccgtgtacaggatatgaagtcacagacggatatgctgacagcgcttggcggaactccggtggcaatgtcctatggtgatgtttataccgctctttccaccggcattatcgatggtaccgagaacaacgagacggcattgaccacaggtaagcacggcgaggtctgcaaggtgtactctgttgaccagcacgcgatgattcctgacgtgatggtcatgtcagcaaaagtatggaacaatattgctccggaggatcaggaaatcatcctgcagtgtgcgcacgatgcgaccgaatggcacaaggaagcatgggatcaggctgtggatgaagcaattacggaagcggaagatatgggtgtggaatttgtctacgatgtagataaggaagctttccgtgaagcgacggcgggaatgatcgatgaataccgcgaagaatatccgggagttgcggatttgctggatagaattgatggaatcagagaagaggaggagtaaaaaatggctaagaccttaggcacgattaagaaatatatgaacaaagttctcgcggcttgctgcgcagtccttctgacgttcatgaccttcctggtattgtggcaggtattcaccagatacgtcctcaacagcccggcggcatttaccgaggaactggtaaagtactcgctgatctggaccggctttatcggcgcggcctatgcattttccaccagagagcatatggcactgaccctggtaagagataaactgactggaagaccgcatcagattctggttatcttcattgatgcgctgattctactccttgcaatctttgtaatcacgattggcggttataagctggcagtgtctgcaagggcggaattctccgcacttctgggagttccgagaacgctggtatattccatcgcaccgatttccggcatctttatcatcatcgcacagattattaatctctacgaagacattaccggaaacaaagtagaagaataaggagggaaaaaatgaatatcgtactaacaactatcattttgtttgtcgttttcggcgtactgctgttcatgggtgttccgatttctgtaagtattattgtatcttccatcgtaactgcaatgtctaccctttcctgggatcagattacgtttattaccatgcagaagatgaattccggtatcgaaagtttttccctgctggcggttccgctgttcatcctcgccggtaacatcatgaacaatggcggtatcgcaaagagacttgtcaattttgcacagctttttgtgggaaaacttccgggaaacctggcacaggccaatatccttggaaacatgctttttggagcgctctccggttcttccgtagcggctgcatctgcaatgggcggatgtatcagtccgattgaaaaagagcaggagtatgatccggcttactcggcggcagccaacattgcttccgcaccgaccggacttctgattcctccgacctctgcattcatcgtttactctaccgtagccggcggcgtatccatttccacgctgttcatggctggatatgttccgggtatcctcatgggactcggctgtatggtggttgcgttcatctatgcgaaaaaaatgggcatcaaggcgaccggccgtgacaaatccatcagtgttgcaaagacgatctgggatgccattccgtccctgctgctgatcattatcgttatcggcggtatcgtatccggcatctttactgcaacagaaggtgcaggtattgcagttctttactgcctcatcctgtccatcatctacaagagtatcgatttcaagggatttatggagattctcctgaactctgccaagacttccggaatcatcctgtttttgatttctgcttcttccgcgatgtcattcgtgatggcttattccggaatcccggcagcaatcagcagcgcgctgctctcggtatccacaaacaaatatgtcatcttcattctgatgaacgttattctgctgatcatcggtatgttcatggacatcacaccggcaatcttgatttttacaccgatcttcctgccgattgcacagagctttggcatgagcgacatccagtttggcgtaatgctaattttcaatatgtgccttggaaatatcacaccgccggtaggctccgtactttttgtcggatgcggtatcggacatgtatcgattgaggaagtaacaccgaagcttattccatatttcctggtactgattgtgatgcttcttctggtaacctttgtaccgggactctccctcggagttcctagcctcatgggattagtctaaggatagacctgtggaattgccgcaataagcatagaacttctttgctttgataagtaatattatcaaaagaccacaccgtgggatttcagatggaaatgcggatggatattcggttcaaaaaatgtggcatttctaaccagccgaatgtttgcatccttgatgatccgtgtctttccaagtttggagcactccacggactgtgtccgcaaatcatgagacaatttaagaactttcgtgtggcgcttttgccgctgctgaataaaacataatcgcgcgaagccgatgtctgagttgccatctgccttatcttcaatagcagatggcaatgagtttcggttcgcgcgattttataatgtctatgaagcagcggcattagccgccactagaaagttcgcccattgtctctgatttgtcggacacactccgggagtgttcaaacgtggaagagacacggaatccgatgcaaacattcagctggaagaaatgttcacatttttctccaacgaatattccatctgcatttccacatgaaattcccaagtgcgtttctcataatattacttatcaaagcaaagagcgatatgcctattgcgacagttcctttgtgtaagaggttatcttacaaagagatatgccgtgtaggcgacgtataataacacgcagacggcgccctccgcacggctcatggaccgtttggttctcgcgaaaacaaacagcaggataccgctgcagagcagcaggacgcagtcgatcactgattcgccgagcacatgaagcggcgagatggcagcggacatgccgaggataaacaagatattgaagagatttgatccgaccgcattgccgagcgccagcccgctgtctccttttctggttgccacaatcgaggtgacgagttctggcagggaagtgccgatggcgatgatggtcaatccgataaaattctggctgacaccgaagtttgcggcgatgatgcaggcgttgtcgacgaccagatcgccaccgaagatgacagcggcaagtccgccacccataaagaggatacttttcggaagcggtaataccttacagacctcgccttcctcacggttgcgcagggcggaacggatcatgcatgtgatgtagagaaccattcctgccagaagaagaaaaccttcgacgcggccgagcgttccgtcgagaaacatgaggcacagaatcagcgtgaccagaatattgacaggcatgtcccgctttaagatctccgcgttcgtctgaaagccggacaaaaaggcgcagattccgaccacaaccagaccgttgaatatattcgatccgacgacattgctgatggcaatatcgttgctgccgccaagcgccgcgttgatgctgacggacgcctccggagcgctggttcccatggcaacgatcgtaagaccgatgatgacgctgggcacctttaagattttggcgagcgaagaacttccctccacaaagaaatccgcgcccttaactaagagtacaaaaccgatgagtaacaatacatattccatacgtgttcctttcctgcgacaaagaaatgggtataaaaaaagacctttatcgcatcaaaaatgagtgataaaagtctcgttacttacaataataaccggccttgcggcgtgatgacgattattatttcagcttctgcgcgcagcgtctggcgcatccgaagatgaaaactactcccttttattaaggctattttaggacggggcaaaaaagatgtcaataaaaatgtcgctatttgtcgaaatccaaacgaaatccaagcggaagccaggtggaatctgcatgaaatccgaacgaaatccaagcggaacccgggcggaacccacatgaaatccaggcgcaatgagcgcggtatatcatccggacggttttgcaagattatcgttgtaacaatcgatagatatgtctataataacagataacaaacggcaagagaacggagcgtgaggacacatgttttttattatgggaattacggacggcagaaaagattttgattttcaccagatgatgacctgcgatgcctgcggagcttacggcagatatcaggtgttcatgacatacaccgtattttcgcttttctttatcccctgcataaaatggaacagacactactatgtgcaggcgagctgctgcaatgcgctctatgagctggacgcggagattggaaaacggattgcgcgcggcggggatgtcgagattctgccacaacatttgcgtccggtgcatccggggaatcgtggaaacggctggaataccacaaaacagtgcagaaattgtggttttacgacgacggaggattatgaattctgcccgaaatgcggtctgcggttttaacagcggcgcgggatgcggaatagaaagaggttacaaaggagagaacaatggagacatggtattatgaagtggtctcgatcgatggagattacgcgaacttaagaagaacggatatcccgtcagaagatctgaagcttgtggcgcgggcactgcttccggcggagattatggagggaagcagattgaaatacgagctgatgcagtacgagattgtggaagcatcggtcggctgaggaacgacgatcgatgtggaaccggtgcacgagatgcaaaaagtgttgtttgcggcggatgagctgaccgggctgatctgggcggcggcgctgcaatgagcagatgataagccactatgcagggtgggaaaagcagattgttttcggaaattcgctgcaaacaccttgacagttctgattttttgaaatagaatctaaagcagcgcgaagaagagaagagtaccagtgcggcaccctacagagagagatgcatacggtggaagcatcttggaagaaagccctggaaagaccacctctgagcggccctaatccggtccggtgattccgttatcatcaaacgagtgatttcccgacagtgggatgcgtgatccgaggggatccggcagtccggcatggttttacgggaataagcagggtggaaccgcggatacagtatattcgtccctcatacaggcacaggtctgtatgggggatttttttcgtccggaaaaagcacccggacgcagaacaaggaggaagaaaatggtagattttaaagcagatgagagactgaacacactcaatcattcctgcgcgcatgtaatggcacaggcagtcaagcacttatacccggaagcaaagttctgggtaggcccggtcgtaaaggaaggattttattatgatatcgatcttggcgataacgcagtcaacgacgacgtgatcgcggcgatcgaaaaagagatgaagaagatctgcaaagagggcaagaagatctacagacgtgagatctcaaaggcagaggcattagagctttttaagaacgacgagtacaagctggatctgatcagcgatctggaggacggaacgatctccgtctacgaccagggcgattttacagatctttgccgcggaccgcacgtggacaatacaaagctctgcaagaatttcaagctggtaaaatattccggcgtgtactggaagggcgatgcgaacaaccacgtgatgcagcgtatttacggtgtatgtttcccgacagccgaggagctggaggcacatctgaagcttttggaggaggcaaaggagcgcgatcacagaaagatcggcaaggagatgcagctgtttatgtccgacgatctggtaggacgcggactgccgatgttccttccgaagggctataccgtatggcaggagcttgagaattacatcaaggcaaaagagagaaaactcggctatctgcacgttatgacgccgtgtgtcggcacggttggtctgtacaagacttccggtcactgggatcactataaggagaacatgttcccggcaatggaggtggagggagagtccttcgttctgcgtccgatgaactgtccgcatcacatgatgatctatgcaaacagaatgcattcctacaaagatctgccgatccgtatcggtgagatcgcacacgacttccgtttcgaggcgagcggtacgttaaagggtattgagagaggaagacatttctgccagaacgacgcgcacctgttcgtgacaccggagcagattgagtctgagttcgccagcgtggtggctctgatttttgacacctacaaagacttcaatatcaccgattaccgctgtgtactgtccttaagagacccggcggacaaggtgaaatatcacgacgacgacgctatgtgggatatggcggagaatgcactccgaaaggtattaaatgatatcggcatcgagtatacagaggagatcggcgaggcggcattctacggcccgaagctggatgtcaacgtaaaaccggcaatcggcaacgagtacacactttctacctgccagctggatttctgcctgccggcgaagttcaacttgacctacattgacagtgacggaacgaagaagactccggttgttcttcacagagcaatccttggttccctggatcgtttcatggcttacattctggaggagacgaaaggcaacctgccgctctggctcgcaccggtacaggcaaagatccttccggtcaagaatgaggatgaggagttgaatgcatattctcatgaggtatacaaataccttgaggataacggaatccgtgtggagatcgatgagagaaacgagaagctgggctatcggatcagagaggcacagatggaaaaagttccgtatcttctggttctcggcaagaacgaagtggcagaccggacggtaagctacagacttcacggagagcagcagtctacgacggtatccatggaagacttcctcgccatgttgcaggaggatatccgcacgaagaaactgaatccggctgccgcaaaataaagaacgatacggcgtagtgttgaacttgtgttgatttaatagtataatcactacgatcaataatataagaataagtgcaagaatagataggaggaatctattatggttacctggaacaacttggatacccttgcttctttcaaggagctttccgaagtggaacgtgtgaatcttgtcgaggcaatgtccggagagaacggtgctgaccgtgtgaagaattacagtgtgccgatggctggcggattttcttacaactatgcagccaagcaggtggatgataaggtgcttgcagcacttgtaaagctggctgaggaagcacagcttgcggagaagtttgaggcactttacaatggtgaggtgatcaacaccggtgagaagcgtctggtgcttcatcacatgacacgcggacagctcggtgatgctgtgacggcagacggtgtggataagcgtagcttctatgtagagcagcaggagagaatcgctgattttgccaacaaggtacattccggcgagatcaccaatgcggcaggagaaaagttcacaacagttgttcagatcggtatcggtggtagtgacctcggtccgcgtgcgatgtatctggcacttgagaactgggcgaagaaaaacggcaagttcaagatggaggcaaagttcatcagcaatgtagacccggatgatgctgcagcagtgctgaattccaccgatgtggcgcatgccattttcgtactggtatccaagtctggtacgacactggagaccctgacgaacgagtccttcgtaaaagatgcgttaaagaaagcgggactggatccttccaagcatatgattgctgtaacgagcgagacatccccgctggcaaagagtgatgattaccttgcggcattctttatggatgactatatcggaggacgtttctcctctacttccgcagtcggcggtgccgtattatccctggcgttcggaccggaagtgttcgcacagttcctcgagggagctgctgcagaggatcagctttccgcaaacaaagacgtattgaagaacccggagatgctcgatgcactgattggcgtttacgagcgcaacgtactgggctatccggcaacggcagtgcttccttactcacaggcactcagccgcttcccggcacatttacagcagcttgatatggagtccaacggtaagtcggtgaaccgtttcggtgagccggtagactacccgacaggaccggtgatcttcggcgagcctggcacgaacggacagcattcgttctaccagctgctgcatcagggcacagacatcgtaccgcttcagtttgtcggctttaagaacagccagatcggcacagatgttgtgatccaggacagcacaagccagcagaagctttgcgcaaatgtcgcagctcagatcgtggcattcgcatgcggcaaatccgacgagaaccgcaacaagaatttcgagggtggacgtccatccagcatcatcatcggtgagcaggtgaacccgcagtctctcggagcacttctggcacactttgagaacaagatcatgttccagggcttcctgtggaatgtgaacagcttcgaccaggaaggcgtacagcttggaaaggttctggcaaagcgcgtgcttgcacatgagaccgacggcgccctgaaggtattcagcgatctgttaaacatttaatataacgaaaaagaactgtgtcacgtcctgcggcagatgcgcggcgtacacagttctttttttgtgcgttgggaagggcggacggcatggcagtattgcaggaatagcggcagtgcaattctttggagcaaaatttcagaagttcttcggatgcgtcaacggcatccggtttgctgtctcttttggcgttcgactgcgcgccgcgggtgtccgcaggcaacggacaaagcgtcggctttctagtctcgctaggcagaccgcttcacaaagtcccgatcagaccgcgcaatccgaaactcggtgtctgcccgcatttaaaacacggcggcagacacctcagacagtcgtttgcgcggtccggttttactcatcggtctgccaagcgagacacaaaagccgtcgaaaatgtccgattgcccgcgaacatccgtggtgcactgtcgaacctcaaaaagacaggaatcatcgcagatgccgttgacgcgtccgatagaactgcggaattttgcgacagaatgcgctgccgcgatttcctgcaatatgcacaagccgtcataacgacaaaagaaaaagaaccgtgtacgccggggcactgccgctggatggacacgattctttttctttataaaaatgtttttaagatctggaggactccattctcccagtagggcgcacaggtatcttttgccgcggcgatgacttccgccctggcgttggcgacggcgtaactcctgccggcgttctgcagcatctcgatgtcgttcaggttatccccgaacgtgcaggtctcttccggtgaaatgccgaaatgcttctgcacgaactcgatcgcggttcccttgttcgcaccgagcggattgcagtccatccactctttgccggcggcggcaagctgtgccttgtccttccatgccggggtgaagagcggcgcacacatttcctcacaggcagatttgtggtagacggtgaacttgatgatatcctgctccgggatgtcagatagacgctctgcctcccggatatcgtagccgtaggaatcgcgcagccagtggaacatgcggcttccggcgtcttcggcgagacagtagtccggtgtggcgacaaaacagtcgcagtgcggcatctgttcctgcaccatgcggcacatgccgctccagacgtcgcgcggcatcgtgtgaaccatcagaatctcctgcggggtgcgcacgaccgtgccgccgtccgtgatgtagagcagctgatctttgatcggtgcaaacagcttccgctcactgatgaactgtctgccggagcagacggcaaaaatgattcctttctggacaagttccttaatgacagtcatgtattcgggatcgatctgcatcgttccgtcttttaccagtgtcccgtcgacatcggtggcaatcagttttatcatgggattctccgttccggggctgatgtgcgccctgttctgtaaatgtttctggatacaacagctgtattataacgtcgggaaacatattttgcaaatatcaacggttgtaaaatgtgcggcaatcaattacaattttatctgggtcatcttaggatgacatacacgaaagaaacagggcatttccggaaaagcggggaatgacttgataaggagagaaacatggcggttggattatgtcacagcgacaaaaaggcggtctgcagaaatctgcagtacagtgagaatgtaaatatgccggacagccccggatggaaatgggtgcagacggtacagacggaagcggcggatcgttatctgatccggctcaaaagcagggaggaaggaagagcgcgcaagacgtaccgcgtggaagtgaaggaagatacagtggatgcaaagagtgcgcccaatgtgacacagattgtgcttctgctactgttgcttccgctgttggggattatttttgcgggactccgctacagcttaacctcgttaaatccgcaggacgatctgcagctggtgctgatacttaccgtgattgccgcgatacttgggcttagaatctggctgatacagcggaaggcggataaaacgctccgctattttctcatgacgcggatcatcaatgcgccgggaaataggaacggggcatatgcgggtgccgcgcagcgcacagcaaaccagacctggagacggacggcatatgcagaagacgcggcatatgccggggacgcagcatacgcaggagaagacattgccggttcggtggagatggaagaaccggaagagcgggtctgggtggcggagtggcacttgtcggaggcgtaccggcgttacagccgcctgcaggcaatcccacttgcggcacttgcactggggggaatcatatttttgtacgcgattgcgtaccggtttaacacgtcccatgacactgcacgcacgatgcttctgatgggagaggcggggctttatatgacattgctcgcccttttgagcaaggtgatgcagtaccgctatctgaagaaagcaaaagcgcaggcaaagcgttatcacgccagaattgcccgcgtcataacaaccgggaaaaatggcgcgaccaaatattatctgtatgagttcatggatgaactggggcgaaagtgcgaggcgcgtgccatgtatccggtacggcaggcaaatgtgggaaatgtgcaggatatggttggcggaaaagcagatatctggtttgatggtgcgcatcttccatatgcattttcagaaaaagacggagcgccggatatccagatgaagcttcggaatctgattgcgggtactgtggcggcagtggttgtgatcgcgctcatgtttgtgtatgcaggaaaccactatgtggcttacaaccaggatgccgacagtctgctgatctcttatgattcccaaaaggcggagtcggatctgacgtttgaggacgtgaaggacgacccgactgtgcgctggatcatagatgcttacgcgatctatgtaccgtttgagaacggagaatatggcgaactgggcggtcattctagagaagactgggatcaggagcaggtgaaggaatatctgtctgactggtggggcattacgagccgggcaacggcgacccgcacgatcagccagatgctgaaaaaaggaaccagagcgtcttaccgtcatgcgtttgaaacttacctgaaaaaagggtatctgtcgatggatgaggatggctatgtcgatattataagcatcagtgagatcccggaggatgagcagtgccggacatgggtatgctatgatgcgtatggacatctggacacgcgcggtgtggatgcttgggattatgtccgtattatgcgcatcacgggactgtgctatcagtgcggctacatcagcctcgaggagtgcctcgaccagtgtctgccgattgcgcagagactgcagaaggaatatggaagctttgaggagatttttgaaagctacatctatggatatcaattctggaaaaatgacagcgatgacgacaggatctatttttaccggagggcggcgggagaagccgtcgaaaatattcagtcggagtacaatacagaactggtaaaagactgggagtaggagagaaggatggaacaggagacacagacaccgcacaagcggcgggtgcgttacaagggaaaatacccgaagaagtttgaggaaaaatataaggaactgcagccggagaaatatcaggatacgatcgagcatgtgatccggaagggaaatacgccggcgggaatgcatatctcgattatggtaaaagaaattctggactttttgcagattgagcccggagagcagggatttgatgcgacgctcggctacggcgggcacacgcgtgccatgctggaatgtctgaaaggacagggacatatctgggcgaccgatgtggacccggaggagtccgccaagacgaaaaagcgtctggaggatctgggattcggggaggatcttttgacggtgcgccttcagaatttctgcacgatcgatgagatcgcaaaagaggtcggcggcttcgactttattctggcggatcttggcgtgtcgtccatgcagatcgacaatccgaagcgcggcttctcgtttaaggtggatggaccgctggatctcaggctcaatcaggagacggggatcagcgcggcggagcggctggatacgatcacgcgggaggaacttgccgggatgctctatgagaactccgacgagccgtactgtgaggagctggcaaaagcgatcacggacgagatccgcaggggcagccgcatcgacacgacgacaaagctgcgcagggtgatcgaggatacgctggattttctgccggagaaggagaaaaaggacacaatcaaaaagacctgccaacgcacattccaggcactgcgcatcgatgtgaaccaggagtttgaggtgctgtatgaattcatggaaaagcttccgggagcattaagaccgggcgggcgcgtggcaattctcaccttccactcgggggaggacaagcttgtgaagcaggcgctcaaagagggatataagagtggtatttacagtgactatgcgaaggacgtcatccgtccgtcggcgcaggagtgcgccgcgaatggaagggcgcgttccaccaaaatgcgctgggcagtcaaggcgtgaaaaaagagaatatatcacaagttttatttttaagagggagaagcgattatgtgtacagcagcaacctatcggacgaaggatttttattttggaagaacactggattatgaattttcctacggtgaggagatcgtcatcacaccgcggaattatgaatttcacttccggcatatgggacaggcagaggagcattatgccatcatcggcatggcgcatgtggcaggggattatccgctgtattatgatgccatcaacgagaaggggatcggcatggcaggtctgaacttcgttggaaatgccgtctacgcagaggtgactgagggaaaagagaatgtggcttcatttgagttcatcccgtgggtgctccgccaatgcgcgacgatggatgaggtgcgggcgctccttgcaaaaataaatctggtcggaaccccgttcgccgagcagttcccggcgtcacagctgcactggatcatcgcagacgaaaatgaggcaatcacggtggagtcggtggcggatggtctgcacgtctacgagaatccggtgggcgttcttacgaacaatccaccgtttgcacagcagatgtttatgctcaacaactatatcggactgtccccgaagcagccggagaattctttcgcaaaagatgttccgcttaacacttacagccgcggaatgggtgcgttgggacttccgggagatctctcttccgcgtcccgttttgcgcgtgtggcgttcacgaggatgaatgccgtttccggcgattcggaggcggagagcgtcagccagtttttccatattttagggtcggtggatcagcagagaggctgctgtgaagtggcggaaggaaaatacgagattacgatttatacgtcctgctgtaatgcgaccagaggaatctactattacacgacctatgacaatcaccggatcatgggcgtggacatgcatgcggaagatctcgacggaacaacgctcacctgctatccgatgatcgcggaaggtcaggtgagctggcagaacggacagaattaagactgcggtgagaaaaatgcgacggcgatggcgccgggaccgacatgggttccgatcgtcgcaccgagggagcagaccgggagctggtccgtgtgtccgctccagagtgcttcgctgtctttgatatatttttgcagcatctcatcgctgagtccggtgtaaccgaggcagaaggggcgggtaaaatcgattccgtctgccttttctatttccttcatgagaaaattattcccgtttttggagccacgcgccttgccgagcatgatgatctcgccttccgatacggcaacgaccggcttgatcgccatggcgccgccgagaaatgcggtggcggcggagatgcggccgccttttttcaaatattccagcgtatccaggacaccgagagtgtggatctgctccttggaggcttctaagattccgacaatttctttggctgataatccctgatcttttaacagaagcgcatacttgaccagaatgccctcgccgatggtggcgttatagctgtcgatgacaaaaacttttcctgcaaaatcttctgctgcgatcgtggcactctggtaagtgccggagagacggccagagatcgtgattgcaatgacggtctccccgtccgccaccgccctggcatatacctcttcaaaagcggcgggggataccaggctggtcgtgggaagagtgtcgctctcaatcagcttttcgtagaattcgtgatggctgattgtgacgccgtcgaggtattccgtatcgccgaagcggatcgcaagcggcagaatggtgaggtcttctctggtagaagcagagagatcggatgctgagtctgtgataattctgattttttccataagattctccatatatttttatttttgctgactgtgttcggtcagatagtcagacaggttttcactgatgattgcaagagtgccatagaaatcgcggcgcctttcctccgtcagcccgcgtccaccgtaggagagcgcttctttgatgcgtgtctggatgccgcttacaacggagcgcccttgaacggtaagcatgtagtgcgaccggtaggatcgcttgtgatcttccggctgttcgcagacgacaagctgccggtcgctaagctgtgagagacagcgggagacggcggctttgtcctccttgcagagttctgtgagctgcgttgcggtcagcccctccgggtgttgtccaaggtaatagagacacatggtgtgactggccttcagcccgaactgcttcatttccagctctttgattttctgtaagtaccggttcaactccaggatggagagtgaaaaggtttcaaaacgatgatccatgggcgctcctttgcaagatgttgataaatcaatatctcggattatagcgcaaagatgttgataagtcaacatctttgcgtgaagatataaatgggatagttgcggaaggataacagaaatgtaaagagtggatatgaaaaaaatatgatataatgttcgcgaaggcaaaagtgagcatggaataaagacggacgtgcatgcttgcatgtgtcggacggatatgttccatgtgaacgcgcccgcgggtccgggaaaccagaggttttccggacttttgccgaagcaaagacgcatatgatataatgcttgtaatagcacaataaaatgatatacaagcggcaaacagaaaaggagcacttttatgcagatcagacatgcaggtacacaggacattccggggattgaccggctcctgtcacaggtattaacggttcatcataacggacggccggatttattccgggcaaatgccagaaaatacaacgatgacgaattaaaggaaattttagaggatacgacgcgcccgatttttgttgcggatgacggagcgggcaatatcttaggctacgcattctgcgttttccagcagcacatcaatgacaatatcttaacggacatcaagagcctctatattgacgatctgtgtgtggatgagaactgcagaggacagcatatcgggcagcagttgtaccggtatgtgctggattatgcgaaggcgtccggctgttacaatgtgaccctcaatgtctgggcatgtaatgaaaatgcgcggaagttctacgagaagtgcgggctcgtgccgcagaagatcgggatggaaaagatactgtaatccgggagacaggaggaaaatatgggattttttatagcgatgtttttatgtaatctattgatgccttctattatggtgatagcgggttactgtatgtacaaaaatcctccaaaagagataaacgggctgatcggctatagaactgccatgtccgaaaagaataaggatacctgggcatttgcgcatgactgttgcggaaagttatggatcaaatcaggcatcatattgctggtgccgacggttctcgctcaaatcccgtttgcaaaatcgggtgaagatgtagtagggacagtaacgcttgtcatcgaagcggttcaggttttggttctgattggttctgttattcttgtggaaaaagcgttgaagcgcacgtttgacgaaaatggcaacaggcgcggatagagtaagagacgcagctgaaagaggggggagatatatgaaagcagatgaagtgataagccgggttgcggatctttgcagagagcatggtgcgaaaaaagtgattttatatggatcgcgggcaaaagggacagccggggaacgcagtgacatagatattgcggtgtccggcggggctgattttgatgagctgcttgaaaaagtcgaagaactgccgaccttgtacagtgttgatttattaaatatggatacctgtaggaatgatttattgatggaggatataaaacaatatggacgcgaaatttgacagacggtttcaatcattttgcaattcgctggatgctttggcggaggccagggaaagagatcttacggattcctttgtattaagcggaaccagtgcaaaatttagtattacttttgatttatcgtggaaggtaatgaaggacatattggtacagtattatgcaataacaggattcgttacaggttctccaagggatgttctgcgtgaagcatttaaggcaaacttgatttcggatgatacatggatggacatgctcaaagtaagaaatgaactcgcacatgattacgatagtgagattgtgaaaacatattgtaacacaattgtgaaagagtatattgcttcccagccggatcatattttgtcaatattatgagagggtaattagaagatgtacatatttttgctaatcttaatttatatcgcttttatcagcctgggcttaccggattcacttctgggatccggctggccggtgatgcataccgaactcggcgtgccggtgtcctatatgggcatcgtatctatggttatctctggcggaacaattatctcgagtcttctttctgataagctgaccagaaaattcggcacgagaatcgtaaccgttgccagtgtttttcttacggtcattgcgctgttcggcttttccttttccagccggttctggatgctgattgtttttgctgttccttacgggttgggagcgggagccattgacgcagcacttaacaactatatcgcgcttcattataaagcgaagcatatgagctggctgcattgcttctggggcgtcggtaccatcgtcagtccgttcattatgagctatgcattggcaaacaggacatggaacagcggttatcgcatggttgggctgatacagcttggcattgcactgcttctgcttgttactctgccggtatggaatgtgaaccagagtacatcccgggaggacggaaaaagtgtaggtctaaccggtgcgcttaagatcaagggggttccgtttcttttgcttggatttttcgcttactgtgctgcagaagctacgactatgcagtgggcaagtacctattttgttgaggtaaaagggattgctgcagatcgtgcggccggttttgccgcgctgttctatatagggattactgccggaagattcatcagcggaatcattaccgatcggcttggcgaccgtaaaatgattttgctgggaaccggtattcttgtctgcgggatttttatcctgtgccttccggtgaagtcctatacggtcgcgtttgcagcttttcttgtgataggtctggggtgtgcgcctatttacccgtgcattatccattccacaccatataatttcggggcggaaaattcgggagcgattattggaatccagatggcaagcgcttatgtcggttcgacgtttattccgccgctgttcggactcctcggcaatgcggtatctttttccatcctgccggtctatctgctggggtttgttgtcctgatgattacgatggtggagacaacattccgcatcacccgcaaggaaaaagttgtaaaaatataacagatgtgtatgatagaaatcagagagtcacacacaaccaatttaaggaggaagaaaaatggcaaaggaccagagatttgaaaaggtttattcccagggaacgatgacgaccacggaaatctgggtggacaaggaaactggcgtgaattatgtgtttcacgcaagcggatatgcgggaggaatgacgccgcttctggaccgcgacggaaagccggtcatttcgccggtgataaatgaataaaaaggaactgccgcaataagcataccgtgctttgctttgataagtaatattataagaagaccagagaacaaaaaagttccagaataaacagacggcggcaaattctttgaagcaaaattcgtgtatttcttccatgccgtggctggcatcccgttccgtgtcttggccatgtttggacactcacggagtgtgtccgacaagccgcagacaatgagcggactttctggtgtccctaatggcacctcttcacagacaatataaaactgcgcgaaccgaactcgccggcatctgctattgaaaatagggcagatgccgactcagacagcggcttcgcgcggttatgttttgttcgacataaagatggcatttatgccatctgttgtctggtgccgcaagggacacacacaaaagtcctaaaattgtctgctggcttgcggacacagtccgtggagtgctccaaacttggaaagacacggatcatcacagatgccagcagcggcatggttagaaataccggattttgcggtcagatttgccgccgcatggttatctggaacttttaagtatctgtttcttataatattacttatcgccccaaagaggtctatgcttattgcggcaattccttattacgccaatattatgccgcctgaccggcactgctctttccaaacagcttctttaagcagctgaaggcaaccagaacgccgagcaccattaaaagtacggcaacgatgaactgcagtccgtcgacgaggaatgtcgcctgaccgcccgcgatgtttttcaccagagcgatcgtcttctggatgagtgcggtgaacgtcacggcgagcatggcaaacatcggtatgtagagcgtccagccggtgcgtccggttgtctttaagaagactgccagtgcgatcaggacgagtgcggcgagaagctggttcgcggaaccgaacagcggccatacattgttatatccgccgagtgtcagcagatagccgaagaacagggtgatgaccgtggcaaaatatttgtttgtcagcacgcgctgcagcggagacatttttgctggatcggtcgtgtcgccgtagaacagttcctggaaggacatacgcccgatacgtgcgacggaatccagagatgtcagcgcaagcgcggagacgcacatggtcatgaagaccgtggcaacctgtaccggaagaccaaacttctcaaggaaaccggcaacgccggaggagaagatggcgaacggagttccgtccggtttggttccgtttacggcgacagcgccgacaacgacaagggagacaatgccgagcagagattctacgaccatggcgccgtagccgaccatcggcatatctttttcgttgctgatcgtcttggaggacgttcccgaggagaccaggctgtggaaaccggagacggcaccgcaggcgatcgtgacgaacagcgtcgggaaaaggctgctgccgtttacggtaaagccgttaaaagcgtttaactgcatggcaggatgagcgacgagaacgccgaccaccgcgccgatgatcatgccgagcagcatgaacgttgtcatataatcacgcggctgcatgagaagccacatcggcatgacggatgccagaaacagatacgccatgacaatgtagatccaggcggatttggtggtgcagatcggaagtgccatacccactgcaaacatggcaacgagcagcgcgattgcaacaaccgcttttaccacttcattcatcttgccgacatgcttctggatcagaccgaagacaacggcgacgacgataaagagcatggagatggaagcagcggcggagtttgcgtaggaggtctcggcagtcatgccgtccacgccttttccgacgaacgtaccggcaaccatgtccgtgaacgctgcaatgacaagcagggtaaacagccagcagaacagcatgaagagcttccgtccggtcttgccgatatatttttcaataatcatacccatcgacttgccctcatttttgaccgaggcatacagcgcaccgaaatcctgtaccgcgccgaaaaacagaccaccgatgatcagccacaagagtaccggcacccagccgaatacggaggctaagatcggaccggtgacaggccccgctcctgcgatggaagaaaactgatgagaaaacacagtaaatctggaagacggtacgtaatcctccccgtcctcatgggtgtaagcaggagtcttggcgtttggatcaatgccccatttctttgccagccagcgcccgtaaaagaggtagccggcacccagtgctacgattccgattaagataatcactaaaccattcattttttttcccgcccgaaggcggctcctttctgatagatcaacattgggcaaagagaaggatggcattttctgtaaaacaaaaacgcccccgtcccgctgcacgaatgtgcagccaaagacgaaggcgtaagcttccgcgttaccactttgcttgtcgtaaaaaacgacctctcaatctcatctttgcgggcgtaagcctgcagcaataagcttccctgtaacgggggaatcccggtgacacctacttggttcagtgcactgctcgcagaggatagttcctgaaaccgcataccgtctcgcaccgaccgacggctctctgtgatgcggggaatcagtaaaccgtgttctgttccttgcatttgctctttgtttgattatgaagatagcactgtgatgtgtaaaagtcaagtacaaatttttaatgtaagaatctggtaaagacggttgacaaataaaaaaacataatatatagtattcctatcagaacagtatgagaaaggagcgcggcttctatgaaacagatattatgctttggagattcaaatacatacggattgataccgggaacgaaggatcgctatgactgggacacccgctggagcggacggatcgggcagcggctgtgggaggatggctgccgcattgtcgaggaaggactgtgcggacggacgacggtttttgatgatccgttgcgggatggcagacggggaacggagcttttatctgtgatcttagagacgcataagccggttgatgtggttgtgctgatgctcgggacgaacgactgcaagacgatgtacgatacatcggcggaggtaatcgggagaggcgtggagcggctgctcgaccagatcagaagcagcatcccggacagtaagattcttttgatgtcgccgatcgcactcggcgagggcgttggcgaggcagggtacgatcccgaatttgatgagagctccgttgcggtgtcaaagcggctgccggaggtttaccggcggatcgcgcatgagcggggcatttcgtttctggcggcatccgcatatgcaaagccaagtgaggaagacagagagcacatgaatgaggaagggcatgccgcgctggcggaggcagtgtatgcaaagttaaaggaaatgctcgccggagagaaagagaacgcacagatcccggcctaggtggatcctgcgggacgatgatggctgctgaaccgcccgggagcagacggcataagataacagcagaagacgctgctgcgcggaggaagagacatggcagagaaaaatctggattttgacacggtcattgaccggacacataccaattcactcaaatatgattttgcggtacagcggggaaagccgaaggacgtgctgccgctttgggttgccgacatggatttccaggtttcttcctatatacaggaggcgctctctggcaacgtggcgcacggcatcttcggctacagcgaggtggaaggcagctactttgaggcggttgcgggctggatgagtcggcattacggatggaacgtggaggaaacctggctggtcaagacgccggggattgtttttgcgctggcacaggcggtgcgggcgttcaccgagccgggtgacgcggtgctgctgcagcagccggtctactatccgttttcgcaggtaatccgcgataacggcaggaagattgtggataacacgctcgtgcagggagaggacggaagataccggatcgattttacggattttgaagaaaaaatacgcagctgtaaggtgaagctctttttcctctgcaacccgcacaacccggtcggccgggtgtggacaaaggaggagcttctgcggctgggtgacatctgcgagcggtacggagtgattgtggtcagcgatgaaatccacgcggatttcgtctttgagggatcgcatcaggtgctggcgggactcgaggaaagctaccggaaatttgtggtgacctgcacggcgccgagcaagacctttaaccttgcgggacttcaggtctccaatatttttatcccggatgatgcgctgcggcggaagttcgagcaggcggtcggggcgtccggctacagccagcttaacaccatggggcttgtggcatgtgaggcggcgtaccggcacggcgaagagtggtatgaagcggtgaaagcatatatccgtgagaatcttgcctatgcgcagcattttctggaagaacagattccgcaggtaaaggcggtggagccggagggaacgtatctgctgtgggtggatttccggagtctgggactctcaaggagggaactggaggatctgattgtaaaaaaggctggactgtggctggattccggtgacatcttcggcgcggcgggaagaggcttcgagcggatcaatgtggcatgcccgcgcagcgtgctttcggaggcgttagagcggctcgcgcgtgcagtgcgggaatgtgtcaaatgaccgatcgtgtgtaaataggaaccacttatgaaaaatggggtgcaaaggcacctcatttttgttatgttaaatacagttcttgaggacacgaaaacatgccggcagaggaagaaatttcggagaggaggagcatgtgaaaatcaatattgaactggacaaagcactggaggagactgaggtactgatccgggcagcgaaaatgacagaggaagtcaacggaatcctaaaaaaactggaggagccgtcggtacagatgatctccggttttgcgggagacacactggagatactggagcaggcggacattatccgtgtgtatgcggcaaaaggaaaagtctacgcggtgacggcaaagggcgaatatctgcttcggatgcggctttacgaggcggaggaacggctggatcagacgcgtttcgtacggatctcaaattcggagatcatcaatctgaaaatggcaaaacggtttgacctgagtttttcgggtacgatctgcgtgaacctcgcgggagggcagacggcttacgtctcgcgcagatatgtggcaaagatcaagcggctgctgggaatatgagaaagggaatggtgagagatatgaaaaagaaagtgttactgagaggactgttcggaattccaaccgggattgcgatcggctatgtgatcacggtcatgatgtcggcattctggggcgacggcagctactatccgtgtgtgcccgcgtttgtggacgcgatggggagtgagatacgggcagttgtggtgcagacggtgctgtgtggtctggttggcatggtgtatgcggcgggatcggtcgtgtgggaagtggatcgctggagtcttgccggtcagacggcggcgtattttctgattacactcggctcggtgcttccggtggcgtatgcggcatactggatggagcgcagcgtcgcgggcgtgcttagctacgtcgcaatcttttgtgcgatcttcgccggaatctggattttccagtatcttggatggtgcgccaaaataaatcgtataaataagaaaatagcgcttgacaaataagaaatagcgtcctataatcaattcatacaaaacatagtagttttataggaaaataaaaaaacaccatagaaacggaaatgaattgagaacaggaggattttattatgagtaaaattgctgagagcgcactggacctgattggaaacacacctttattaaagctgaaccgctactctgcggaagcaggcgtaaaggacgcaacgatcctgggaaagctggagtatttaaacccggcaggatcggtaaaggatcgtatcgcactggcgatgatcgaggatgcggagaagaagggcatcttaaaaccgggcgcaaccattattgagccgacctccggcaacacaggtatcggacttgcagcagttgctgcggcaaagggctaccatgccatcctgacattgccggatacgatgagcgtagagcgcagaaaccttctggcggcatacggcgcagaactggtactgacagagggcgcgaagggcatgaagggcgccattgccaaggcagaggaattaaaggagtccacaccgggcgctgtgatcttaggacagttcgtgaacccggcaaacccggcggcgcacaaggcaaccacaggaccggagatctgggagcagacagacggtaaggttgatatctttgtagcaggcgtaggtaccggtggaacggtaaccggtgtcggcgagtacttaaaggagaagaacccgaacgtgaagatcgttgcggtagagccggcgaccagcccggtattatccaagggcacaccgggtgcacataagattcagggtatcggcgcaggatttgttccggatgtactcaacaccaaggtgtacgatgaagtcatcacgatcgagaacgacgacgcatttacagagggaagagcgtttgcacgtagcgaaggtatcctcgtaggtatctcttccggcgcagcattaaaggcggcagccattctggctgcaagaccggagaacaagggcaagacgatcgtggctctgcttccggattccggagacagatatctgtccacctccctgtttgcaaagaactaggagaccgctcgaagagcaaatgccggatcctttggcagcacgggttttgcctgtgccgccggagggtctttttttgaccgtgaaatgtgtggaaggtctgtttttgaccgtgaaatgtgtggaaggtctgtttttgaccgtggaaagtgcggaaggtctgttagtgcatgggaaaagtgcggggcatcccggaaaaacaggcgcagagacaggaaaactctggacatttgctgaaaacatgatatgatatcaaagtatcacaatgacaatctatcgtgacaggtgtcttgtcacctgaaaagcggatgtatagagaacggagataaaaatggaagcagagagagcgaagcggatcaaggaattgcagaaagagaaggatgttgtcattcttgcgcattattatgtggacggcgccgtgcaggagattgccgattatgtgggtgattccttttatctgagcaaggttgcgacgaaggtgccgcagaagacgattctgtttgccggagtgacgtttatgggtgagagcgcgaagatcttaaacccggataagacggttgtgatggcggacgagtgtgcggactgcccgatggcacatatgattacggcagaccggatcgcggaagtgagagaggaatacgaagatctggcagtggtctgctatgtgaactccacggcggagattaaggcggtatcggatgtgtgcgtgacttcctccaacgcggtaaaagtcgtgtccaacattccgcagaagaatattttcttcgtgccggacaacaacctcggcagatatgtggcggaaaagctgccggagaagcatttcattttccacgacggcttctgccatgtgcataagagcattcacgcggcagagctgcaggcggcaaaggatgcctgtccggacgcactggtgctgacgcacccggagtgtaccgaggacgtggttgcgatgtccgatttcgtgggaagcacgtctgagattattgattttgcgacgcagagcgactgcaaaaagttcatcatctgcacggagatgggcgtattctttgaactgcagcagaagaatccggataagaagttctattcggtgggacacagacagttctgcccgaacatgaagaaagtgacgatcgataaagtcgagcaggtgcttgagaagctcggcagcggagaacttgaggagatcacgctctccgacgagatcctgacccgtgccgcaaagccgctgcagcgcatgttggaacttgcaaaataacggcggacgctatatgatagaagcggacaggcgtaaacgttacaatatacaggagtatctatgttaaatcaattttccagaacagaattattattaggaaaagaggctatggagcggctctcgcgtgcgagggtcgctgtttttggcattggcggtgtgggaggctacaccgtagaggcgctggtgcgcagcggtgtgggagctatcgatctgatcgacgatgataaggtctgcctcaccaatctgaaccgtcagatcattgcaacgcgcagcaccgtagggaaatataaggtggaggtcatgcgggaccgcatcctcgacattaacccggactgtaaggtggaggtgcacaagtgcttctatctgccggagacgagagacgagttcgatttttcgagctattcgtacgtcgtggacgcagtcgataccgtgacggcaaagattgcgctggtcatgcaggcgcaggagacaggaacgccgatcatcagcagcatgggcgccggcaataagctgaatccggcaatgtttgaggtggcggacatctataagacgtcggtctgcccgctggcgaaggttatgcgccgcgagctcaaaaagcgcggggtgaagaaactgaaggtggtatattccagggagcagccggtcacgccgatcgaggatatgtcgatcagctgccgtgcacactgcatctgcccgccgggagcaaagcataaatgtacggagcgccgtgcgattccgggttccaacgcatttgtgccatcggtggcaggattgatcattgcatcggaggtcatcaaggaccttgcggcagaatagagaatgagggacaggcatgtatcagagaaccatagaagaactgcagaaggacgagcgggaaaaagtaatcatagacatccgcagagaagctgattttttgagagagacatatccgggagcaaagcatatctactgggaggagtttgaggcgcataaggacgaggtgcccaaggactgcccggtctacctgatctgctatacgggagagcgcagcgacgagctggcgcgcgagcttttagaggagggttatgaggtatacagtgtgcagggcggataccgtgcgtacctgcgcatgaagctgttagaatccatggaacagacaaaagcgccggatgccgaagagaagaacctggaccgctgcagcgagatcgagcgcagcattgtcaaaaagttccgcaaagagatctggcggaagttcacaaaggcgatcaacgaatacgagctgatccaggacggtgacaagatcgccgtctgtatttccggaggaaaagattccatgttgatggcgaagctgtttcaggagctggagcgccacggcaagaagaatttcgaggtggtattcctcgtcatgaatccggggtacaatgagatcaactacgagacgatcgtaaacaacgccagaatcttaaacgtcccgatcacggtatttacttccgagatctttgacattgtggcgggtgaggaggaatctccgtgctacctgtgcgcgcgcatgcgcagagggcatctctacagcaaggcaaaggagctcggctgcaacaagattgcgctggggcatcattttgatgatgtgatcgagaccatccttatgggaatgctttacggggcgcaggtacagacgatgatgccgaagctgcacagtacgaacttcccggggatggagctgatccgtccgctgtatctggtgcgcgaggaggacatcatccactggatgaattacaatgacctgcactttattcagtgtgcctgccgtttcacggaaagctgtgcttcctgcggcggtacggagaagggttccaagcgcgcggagatcaaggatctgatccgggagcttcgcaagaagaatccttacattgagaagaatatcttccgcagtgtggagaacgtcaacctgaacactgtgatcggttataaaaaagatggtgtccgccatcattttctggatgaatatgacaaagcataatctttgattttgtgtcatttttatccccccgaggggcttgtgcggcccctctttttcatgctatcctttgtgcactgggcagaaatgccggcaattttaacaagggagaataaataatgaaaaagaggtggatggcgctgcttggggcagcggtagtgacgatgaatctgtttgccggatgcggcagcacaggtgcggagcagacaggcaataacgcagatggtacggcgacagaggcagtacagggaaaagacagcgccggagacgggaatgcggcgcagagcgtggcaggaaccgcggatacggtcatcgtggcgatgagtccttcgtcggagccggcggcgggatttaacccgtgcatcaactggggctgcggggaacactgccatgagccgctgatccagtcgacgctgatccggacgaacgtggatatggagttcgagaacgatctggcgacggattacagtgtgagtgaggacggactgacctggacgtttcacatccgggacgatgtgaagttcacggacggggaaccgctgacggcgtctgatgcggcatttacgtttaacacggcgcttgccacgccgaattcggaggcggacttaagtatgctcgattctgtggaggcaccggatgataccacggtgattttccacatgagcaagccgtacaatgcgtttttgtatacactggcggtgttcggtatcgtgccggagcactgctacgatgaagcagcctacggggagaacccggtcggttccggcagatatatcctgacacagtgggacaaagggcagcaggtcgttttggaggcgaatccggactactacggggatgaagtgcagatgaaaaaagtcattgtcctgttcatggaggaagacgcggcgcttgcggcggtaaaagcgggacaggtggatatcgcctacacgtctgcggtgtacagcgacgagcaggtggacggctatcagcttctggtctgtaagtcggtggattccaggggaatctcgcttccgtcgattccggcgggcagcgaggttgtcgacggggataccgtgtatgcggcgggaaacgatgtgacatgcgatgtggcactccgccgggcgatgaactacgcgcttgaccgtcagaccatgatcgatcatgtgttaaacggctacggcgaggtcgcttacagcgtatcggataacatgccgtggtcgagcgagtccatgattatcccgtatgatgtggaaaaggcagagcagattcttgcggacggtggatggagtgatacggacggcgacggcattgtggaaaaagacggacagaaagcggaatttaccgtgtattattccgcgtccgattccgtgcggcaggcgctcacggcagagctctccaaccagatgaaagcggtaggaataaacgtattatacgaaggtctgggaagctgggacgagttgtatacaaagatgtactccgacccaattacctggggctggggttccaactcgccggtggaggattatcagctgtattataccggcggttcctgcaattttacgggatattccaatgagaagacggacgaacttctggatgcggcacttgctgcgacagatatgaatgagtcctacagtctctggcagcaggcacaggaagatgtcggaccggatgccgaggcactctgggtatggtttgccaacgtggatcatctctactttgcgcgggatggcctggcagtggcggagcagaagctgcatccgcacggtcacggctggtcgttagtcaacaatgtcgaccagtggacctgggaatagatgagggaagaatgaatatcaggcattacataagctttttcataaaaaatgtaataaaaatgctgacactgctgatcggtgtcagcattgccgcgtttatgctggtgtcgctgtctccgattgatccggtacaggcgaacgtcggagcgacggcttacatgcgcatgacgccggagaaacgggcgcagatggagtcctactggggaaaggatgtgccgccggcggagcgctatctgaactgggcgaaggattttgtgcggggggatatgggcacttcgctgaaatataaccgcccggtcgcggaggtcgttgcggagaagttcggcaactcgtttgcgctgatgtgcgtggcgtgggtactgtccggaattctggggcttgtgctcggcattgtggcggggtattttaaagaccgtctgccggaccatctgatccgcgggtatgcgctgcttctggctagcacgccggcattctggatcggtctgctgctcttgatgatctttgccgtgtggctcggctggctgccgttcggcatgaatctgccggcaggcatgacggcggcggaggcgggcatcggcgtgcgcatccggcatctgattctcccggcgctgacgctcgggctgacgggcgtggcaaacatcacgctgcacacccgggaaaaaatgattgcgatcatggagagcgactatgtgctgtttgcgcgcgcgcgcggggagagcagcggctatatcgtaaaaagacatgccctgcgcaatctggtgctgcctgccatcaccctgcagtttggttccatcagtgagatctttggcggctcggtgctcgtggagcaggtattttcttatccgggactcggacaggcagcgattgatgccgggctggggagcgatgtgtcgctgcttttggcgatcacggtcatcagcacactgttcgtattcctcggaaatcttgcggcaaatgtactttacggtgtgattgatccgcagataaggaggggcagaagtcatggataaaaccggtcatatgacgattgctgcccacacggcgggcagacgcaacgggcgccagtggatgcggcgctttcttctggcggcagtgctgcttttagcagccgttgcagtggctggaatctgtctggaggagcgggcggtggtcacggatttttcgcgcaaaaatctgccgccgtgccttaagtatctgtttgggacggactggatggggcgtgatatgctgtcgcgcacgctggcggggctctccacgagcatccgcatcggtgtgctggcgtcggcggtcagcgcagtgcttgcgcttttccttggaactgccgcggcggtcggcggaaaatgggcggacggcatcatcagctggtgcattgatctgatgatgggagttccgcatattgtgctgttgctattgatttcctacgcgcttggaaagggtgaaaagggtgtggttgtcggtgtggcgctgacacactggccgaacctcgcgcgcgtgatccgcggggagatcctgcaggtgcgggaggcggcgtacgttggcattgcaaaacagctcgggaaaagtccgtggtacattgccagatggcacatttttccgcagattcttccgcagttccttgtgggactggtgttattgttcccgcacgcgatcctgcatgaggcgagcatcacgtttctgggctttggactgccgccggagaagccggcgattggcgtgatcctctcggagagcatgtcgtatctgagcaccggaaaatggtggttggcgctcttcccgggactggcgctggtcggcgtggtggttcttttcgaccggatcgggagcggcttaaaggcgctgcttgacccgtcgagcgcgcagctgtagaagattttgagtggagaaaaacgatggaagagaaaaaagaattactgcgcatcgagcatctgacggtatctttcgcgcagtatgagaagcgcagcgcaaagcaaggggaacttccggtgatccgtgatctgaatgtgacggtgcgtgagggtgagatcgtcgcggtcgtcgggagcagcggatcgggaaaaagccttctggcgcatgccataatgggaattctccccgccaatgcggctgcaagcggcagtattttttaccggggaagcgcctgcggcgaggcggaattaaaggcgctgcgcggcagggagatcgcgctggtgccgcagagtgtcaattatcttgatcctctgatgaaggtcggcagacagatcattggggaaacgaagaagcggcagaagcttttttgcggagcagaccagggaaagcggcagaagcttttttgcggagcagaccgggaaaagcggcaggaggaagcgcggatgcgggaactccttgcaaggtatgggcttgcggacgaagttgcggatctctatccgtttgaactatccggcggcatggcgcgccgtgtgcttttactgacggcactgatgtggcagccgcgcctgatcattgcggacgagccgacgccgggcatggatcttgcgctggcaaaacaggcgatgcaggatttccggacatttgcggacgatggaaacggtgtgcttctgattacacatgatctggaactggcgcttgaagtggcggaccggatcgttgtgttttatgccgggacgaccgtggaggaagcgaaggtgacagattttgcggacgagacgctgttgcggcacccatatacgagagcgctgtatgaggcgctgccggggcgcgggtttgcggcactgcccggaacacagccttacgtcaaagatctgccggcaggatgtccgtttgcaccgcgctgcgccgaccgtcgggaggcgtgtgacggggagattccggtcgcttgtgtacgcggcggcagggtacgctgcatattgtatacagagaattcataaagaactatcagagggagaggaggaaacgtccggtgagactgaaagcggaacatatcagctataaatatccggggggcagcagagaggtgctgtcggatgtgagtctggaactggggagtaccgaccggctggggatcgccgcgccgagcggctttggtaagacgacgctctgtcagattctggcgggctgccgcacgccggtgactggacgtgtctgtgtggatgatatgccgcttccggggagcggttactgcccggtgcagatgatctggcagcatccggagcaggcggtcaatccgcgcgtgcggatgcaggcggttctgcaggagggagattcgatcagcgaacgtgtgatagaggggctcgggattgagcgggattggtgtaaccggtatccgggcgaactatccggaggagaactgcagcgattctgcatagcgagggctctgggggagagaacacggttcctgattgcagacgagatcagcaccatgctggatcccatcacccagagccagatctggaacttcctgctggcggaagtgaaagaacgaaaaatagggcttctggtcgtaagccacgacgaaaagctgatggagcaggtctgtgaccgcatcatgcggctgtgatgcctgcaaataaaaagaaaaatcagaatattatcttcgcgcggttcttcaataagcgcgcgccattcacaatgagaagaattccggctgcaatgccgcctgtcagtacgcagatgccgacggcaaggcttgcagcgccagtcgatcccattgtcttgtaaatcttttcttccataaaaacaacctccttaatacaaaacaatccatttatggttagtattttaccatcatttggcggaatatacaagaaaacggtcacggcagccagccgtcgtcccccgccagcacaagctctctggaaaaatgggcagcctgtgcgccgtctaaggtatccacaaagtctgcacgctgtgcaaacgggcggcagctgtctgcacagccacagtcagcgtcctgtggataactgtgatactcggcaaaaagaacggtgccgtgtgcgtgctccttgccccagtcatgaaatccggcaggatgaatgtgggcgcctatcgcgcagtccatgaggacaacccgtgcgtaatcccgccagggacggccgatataggccgcgtgctgaggacaaccctccgcggcaaagcggcagtcgtggaaaacatagccgtattcctgcccttcgggggtggaagcggcggtgacatatccgggtcctaaggatgcgatcgtacagccttcaaagtaagcggtcgcactgccgaaaataaagtcgatatcgccgcagatatagcagttgtgataatattgtctgccgttgatgcgcggtgcggactcggtcggcccgcgaaagccgccgggctcgtattcctccgggggaagcggaccggtaaaaagcgtatcctgatgcccgagaatccggcagtattccgcgacaaaacggtcacattcggcatagagtgcaattgcctgcccgtgcgttttggagtcgccggcagtattctcgatggttaagttgcgcagcgtaacgtctgcggcatgcacgaaaaaggtgtaggagcggaaggttccgcgcttgatgccgtccgacatgatctcgtagccgtaatcgccgaaggagatcacggtgtcggacggggatgctcctgcgccctcgatcgtgacgttcgggcgtgtgagggataatttttcgtggtagattccgggcatgacgcggatggtcacgggaaccgccggatcttccggcatggcggcgaacgccgctttcagtgaataaaagccgccagagacatctgcccctggcgcaacggtcattgtatacataagtggcttcctttttggaaaaatagaattaacgggcgagaatatcgatgatctccgcgacatacatggtgtgcatatcgccgtccttgtaccatttttccttgatctcagggagaagaaaagagtcttccgtgatgcgggtggcagacattttctcgcagagaaggacaaagttgccctcgtccacgtaagggatgttgtggcgcgtggcgaggttaagacctgccgcggcgaatttgtcttcgtctcttccggaatgggaaccgcagtaatttaatgcgtcacggtattgcccggacaggaaggtaatggagaaaaattcgttcgcgtcgatgaattctttggtgtagcgggaatcacgcacaaaaatgaaagcaacatttttgccccagaggacaccgacaccgccccagcttacggtcatcgtgttggctttttccttgttgccggctgtgacgagcgcccactctttgccgattttggtaaatggattaaattctacaagatcaaatggtaacggttggaatgtgtgcataagattacttcctttctgtcggtatcatttctgtagatatgataccattttgacgggaaaatgacaagaaagccggcggcaaaacgggatacttttcacaccggaaggggcgcagatgagcgccagagcagttgaaaaaatagacggagtgcgtataatagtaatatagtacgcaaaaggaagaaggaggagcggcgatggcaggattaggccacagacaggatcggggagtcatgctcccgccattggatgagattgacggttttatggtgcgcccgggattttacaattcagaaggcgcagtgccgacggcgagaggagtgagctttacgattcattcggtcggcgcgacgggatgtacgcttctgctgttccggccgcaggaaaaggagccatacgccagactgaagtatccagaggcataccacattggcaacacgttcgcaatgctggtattcggcttgaagattgatgaatttgaatacgcgtttcagctggacggaccgtatgatgagtccagggggctgttgtttgacaagaacaatgtgctgctggatccgtttgcgaaggcagtgacggggcagcggaactggggcgagcgcccggagagtgacgagggctttgtgtatcacgcccgtgtggtggagaataattttgactggggaaaaatgacgtttccggagattccggcggaggatctgatcatatacgagacacatgtaagaggatttaccagggacgcttcttccggggtgacggcaggcggcacgtttgagggactgcgccagaagattccgtatctgaaggatcttggcgtcaacgcgatcgagcttctcccgatttttgagttcgatgagatggagagcgcccgtgtggtggacggcgtgcagctgtacaattactgggggtacaatacggtaagcttttttgcgccgaacaccagctattcgtccgtggtagagcacaatcacgagggagacgagttaaagctgctgatcagtgaactcaaggcaaacggcatggaagtcattctggatgtcgtgtttaaccatactgccgagggaaatgagaatggaccgtgtttttcatttaagggcattgataataatatttattatatgctgacgccggatggacattactacaatttcagcggatgtggcaatgccatgaactgcaaccacccgatcatgcgcaagtttatcattgactgcctgcgctactgggtgatggagtaccgcgtggacggttttcggttcgatctggcttcgattctgacgcgtgaccagaacggggcgccgatgccggatccgccgatcttacaggggatcgcctgcgacccgatcttaggacatgtgaagctgatcgccgaggcgtgggatgcggcaggactttaccaggtgggaagctttccggcatttcgcagatggtcagagtggaacggcagatacagagatgatatgcgccgctttttaaagggcgacgggagcatggcgggaaccgcgatcaaccgcatcatcggttcgacggatctgtacgatccggtgcacagaggtgagagcgcatcggtgaatttcctgacctgtcatgacggttttacgctctatgatctgtactcgtacaatacgaagcacaatgagaaaaacggctggaacaatacggacggcgacaacaacggaaacagctggaactgcggtgtcgagggagagacggacgatccgcagatcgagggactgcgccggcgcatggtgaaaaatgcgtttgcgacgctgctctgcagccgcggaccggcgatgttctacggcggcgacgagttctgcaacacgcagtttggcaacaacaatgcctactgtcaggacaacatcatatcctggctggactggacgaggctggaaaaataccgggagattcatgattttgtgcggtatatgatcgatttccggaagcgctatgccattctgcgcaagaagacgaagccggtggcatgcaatctgccggagatcagcattcacaacggttatccatggaacggcggtacggattccaacagccggctcatcggcatcatgtatgcgggaagagatgagcacgacacgcgggacgatattgtgttctattgtatgaatgcttactgggagacgttagtgatgcagcttccggaactgccgaacgggctccagtggaaagtgtgtgtcaacacgtccgtggagtacgaggacggcagagatatggagtcctgcacagaattttattataagaagacattgaaggttccgccgcgcacggcgatcgtgctggtggcggagtaagcgggctaagcgggcagaaacccgtggcgaatgcctacagcctgcgttgcggctcctagaggtagccgccgtcgagggtgatgatctgtccggtcaggtagtcgtttccggtggtaatctgcacggcaagcgatgccacttcctccggcgcgccgaagcgcccggcggggatttcctcggcgagctgggcgcgctcttcctcggaaaagcaggaattcatctcggtgtcgatcacgccgcaggcgatcgcgttgacctggatgttgctcggagcgagctccttggcgagggcgcgggtgaaggaattgatgccacctttgcaggcggagtatgcgacctcgcatgaggcgccgacatttccccagatcgaggagatgtttaagattttcccggatttctggtggatcatgtgtggcagggcaagcttgctcgcggaaaagacggaggtcagattgacgccgatgatgcggttccactcatcgatggtcatatcttccagcaggccgatatgcgagatgccggcattgtttacaagaatgtcgatgccgccgaagcgggcttcgctttgggagaaaagctgttccatataggtatagtccgatacgtcgccgatgctggtgagtacgtccacatggcaggtttcccttaattcgtctgccagcgccagcagctccttttcggagtgggaacagttgatgaccagacggcagccctccctggcaaaggcgcaggcgatcgcccgcccgatgccgcgtgaggcgccggtaatgagtacggttttatacatgatgaaagacctttcttctatttatattgtgaatacggtatatcctctttttgcgctgctttctgcgcatccgaagttccgcaggaacttctaatatgaactcgtcagagttcattatatcctcttttttgcgccgacttctgcgcatccgaagttccgcaggaacttctaatatgaactcgtcagagttcattatatcctcttttctgcgccgacttctgcgcatccgaagttccgcaggaacttctaatatgaactcgtcagagttcattatatcatatattttaggcggctttgtttgaaatttcaaaaaaattaaaaaaatacaaaatttttctggacaaacagaaaaacttgtgataatataatgaagcacgatttgagagacaacaaagtgcttcataaatatcgatgcgtggctcagcttggtagagcgctgcgttcgggacgcagaggtcgcaggttcgaatcctgtcgcatcgactgactggtagagaccgtcaaccttagagagatcaagggttggcggttttttgtgtatagaatatcagaagaaaaggatcatgaatgttaagagagaagatagtacactttcttgcctgataataggttcactgcttgtcagataggatggattttgttaaaataattacaaaagcaatacaaacaatgacgagaggaggaacctgaatgaactctccgcagacaatcaatgggttaatgcggcatttgagaaatgattgcaaaatacaaattagcggaagttatcaaaaacagcaattaacaagctatggctattatcatgggtataagggataccgttttgccggaaatagttacaggcagattccatattctgatttcagcgaggtggtagcggttattgagtatgataataatttgaaggcagcgctgtatccggaacttatgtttattgagacagcacttaaaaatattgtgtgcaatgaatcagtgaaaggtcttaagcttggcacttttgagcatctttataaagaacgtatgagtgataatacgacaaatacgaaattgcagtcaaaacgccttaaattgcgtaattcggtgtacgccaaattagctgcgcgctatcatgatgaagaagaaaaagaaaatcaaatggtgcggcacttttataatagaggagaagatgcacctatctgggtcgtttttgaaatactatatcttagtgatctggcaggtttttttgagtgcctaaatgaggcggtacgtgagaatatcttaaagcagatgaatatgtttgatatttcgatagatgctaataaaaatttactttctatcatgatttacactttgaaagcactgcggaattctgttgcacataataatattattttcgatactagatttaaagatcggaaaatcagccccgtgcttaaaaaatgggtagaaaaagaaacgggtattcagaatattacgttgtattctctgattgattatattataattgtgtgctgtcttcttaaacgagtggattttagtggtacgagagcattgactttgctaaataagtacaaggaagagaatcagcgactgcagaatagtgttgcttcggagatttacgatcatattatacagaataatgttccggcaaaggttgtggggttagaggcgtatttgaatgtttgaaaaaataataaaaacttgcatttttcaaggatataagatatattatatgtaatgaaagaggtgtatgttttcggactgcactggaggagtcactctgtggctcctttttatgtatgggctttagtctgtatgggcatttaatgccgggtgatatccataggaaggaactcaaaaaggaactcaaattatttgagttcctttttgagttcgtgaaataaaatttgagtttcttacacaaaaaatagtgatacgatataaaaatatggggagaactaaaatgacaacgaaagaattacttgaaaaattagagttaattcagaaacttaaatgtgaaactccaacagataaagagtgcaaaccagggatgtcccagacatttatatgattcgctgtccagtttttccaatcaggacgatggggaatcccgacaatacgcagaacgatgcaggaatatcacttgccacaaccggaatttttggatgaaagaaggagttttattgcgattaaaggaaaaaggatcaaggataaagattctgtcaacagaacgcgaattgccttgtcaaagcccctggtgcagtgtataattgcactgatgatttgcgagtgaagaacacgggaggaagacatgggaaaagacgttattattgcatgtgattttaacagtaaggcagaagtcattgcgtttcttgagaagttcaaggacgagaagccgttcgtcaagattggaatggagcttttttatgcggaaggaccggacatcgtgcgtaccatcaaggggatgggacacaagatcttccttgatctgaagcttcatgacattccgaacacggtgaaaaaggcgatggcggttctctcgggactggatgtcgatatgtgcaatgtacatgcagcgggaacaaagggcatgatgcaggcggcactggagggactgacgagagcggacggcagcagaccgctgctgatcgcggtgacgcagcttacctccacgagcgaggaagtgatgcagcaggagctgtggattgacaagccgatcgatgagacggtcatgcactatgcgaaaaataccatggaagcaggactggacggagtcgtatgctcgccgcttgaggcgggtaaggtacatgcagtctgcggagaaaagtttttgacgatcacaccgggcgtgcgttttgcggacggcgatgtgggagatcagaagcgtgtgacgacacctgcaaaggcaaaggaactcggatcggattacatcgtagtcggaagaccgatcacacaggcggcggatccggtagcggcataccgcagatgtgtggaagaatttgtaggttaggacggcatacacgaagaggagatggacgaaacagcctggtctcctctttttttcataggaagaaaaggacggtggggaagatgcctcaaaaaggattgagcggaagcacattgaagttgatcgcgatcatcacgatgctgatcgaccatatcggagcggcggtcattgccagactgctgattgccggacaggggagtgagatgctctataagatctattatgcgatgcgcgccgtcggcagagtggcattccctattttctgttttctgcttgtggagggatttttttacacgggcagccggaaaaaatatgcacttcggttgtttggatttgccctgctgtcggagataccgttcgatctggcattttccgggaaaatactggaattcggctatcagaatgtatttttcacgctgctgatcgggcttcttacgatcatgctgtttgatgcggtggtgaaaaagcaggagtggcatccggttttgcgcagtgcgctgcttgtcatcatcacattcgggggaatgggtgcggcctatctgctgcacacagattatgatgcaaaaggcgtgctcgcaattctggtgttttatatgacgagacagatgcggggattacagatcgtggcaggctgcctggcgttctgctgggaacttccggcgatcgtggcgtttatcccgattgcgttctataatggaaagcgcggatggaacataaagtacctgttctatgcgttctacccggtgcatctattggttctttatctgatctgtgtagggatgggaaccgcgcagattgcggtggtgtaggagagaaagagaggaagagagtaagtatggagatatcaaaggagacgcggaaacggatgatgcagatcattgcatttgggattctgctctattgcgggatggagcattttgacgtggtgatcggagcggtggattttgtgctggggattgtgatgccgtttctggttggaggcgcgatcgcattcgtgatcaatgttccgatgaagagtatcgagcggcatctgtttgcgaagaacgggaagcttgcaaaatggagaagacccgttgcctatctgctgacgcttgcgcttgtgatcggtattatcacgctggcacttgtggtcgtgataccggagcttggaaatacgatttccatgattgtacagcaggttccggttgcggtaaaagccgtacagaagtggctgacagatcttccggacagctatccggcacttgcccctgcggtggcggagcttaatattgactggtcatcgcttgccgactcgattgtgacgtttgtgcagaattttgcggcgggggttgtgagctccggcgttggtattttttccgggatcgtgagcggtgtggtgacgtttgtgattgcgtttacgttttccatctatgtgctgttccagaaggagcgtctggcgagacaggcaaaacagattctgtacgcagtctttccggagaaggccacggagaagattctctcggtggcagctctgtccaatcaggtgttttccagtttcctgtccgggcagtgcgtggaggcggtgattctcggcaccttgtttgtcattaccatgtcgattctggggatgccgtatgcgatgctgaccggaatcgtgattgcgataacggcgctgattccgattttcggcgcatttatcggctgtgtcatcggaatgcttctgatcgtgatggtagatccggtgcaggcggtgtggtttctggtgctgtttctggtgctgcagcagatagagggaaatctgatctacccgcacgtggtgggaagttccgtcggactgccctccatctgggtgctggtggcagtgaccgtcggcggcaacatgttcggcatcctgggtattctggtgttcattccgctttgctccgtgctgtacgcactgtttgccatgtttgtgaaaaaaagactgcgggagcgggagattcccgagagccgctggaacgcgccgtcaggcggcgctgcggcggccgggccagaggttagtgacaagaccggcggcagcgggaataccgccgggtaatttggggagagaagagggttcttccgcgataagatcaggcagcttttttatccgcagaagagcagtcttgtggataaatgaaaaaaagcctttcggaagtgtaggagggacttccgaaaggctttttgaaatagtgtaatatagtatatggaatatatataaaacccgccggcagtgccggtgagagagtttttaggcggaactgacagaaccccaacccccgcgtcgaaactcaacagctccttttgatgattctatcttatcgggaaaatgtgtcggaagcttgacggcaaaatgaagaatgtcttaatatagtgtaagaaatttctaaaaagtggaaaatatttataaaatggcgttggaaaaaggggaagcattacttggaagcatacgaatatctggaaaaaataagagcggcggcgccgcgggtacactgtatcacgaattatgtgacggcgcatgacgtggcaaacatgatcctggcgtgtggagcgaacccggtcatggcggacgagccgcaggagatgggagagatcacggcgcatgcgggggcgctcgcccttaatatgggaactcctggcgagcgcagagagcaggcaatgcttgcggcgggaaaggcggcaaacgggaacgggattccggtagtgcttgacccggtcggcgtcggtgcgagcgcatttcgccggaagatggcagaagagctgttgggggcggtgacgtttaccgccatacgcggcaacatgtcggagatccggacgctttctgaactggcagaaaagaaggcggccggcgccgcgggcggtgtggatgtgcgtccggtggatgtggtcacggaggagacgctcgcggaggcggtcacattcgtaaaggcggtctctaagcgccttggcgcggtggtggcggtgaccggtgcgatcgatcttgtctcggacggacagcagtgtgtggtgatccgcggagggagagaggaaatgagccgggtgaccggaaccgggtgccagctctccggacttgcggcggcgttcctcgcggtggcgcggaatatggaagcgccggctggaagcaccggcgggaatactgcgggaggagcagcatgcgcggcgcgcggcatggaggcggtcgcggcggcagtctgcgtgatgaatgcagcaggagagattgcatgggagcagcgcggtttatgcggcggaaatgcctcctacgggaccggtatcattgatgctgtgtaccggatggaccagaaaatgctggagggaaggattcgttatgaagtgcgataaaagagatctgctgctttatgcagtgactgatcgaagctggagcgagggaacaacgctgggggcgcaggtggaagaagcgctccggggaggcgcgacatttgtccagctacgggaaaaaaagctgaccggggaagcactccgtgcggaggcgttggagatccaggcagtgtgccggcggtacggcgtgccgtttgtgatcaacgacgacgtggcgcttgcgaaagagattgacgcggacggggtgcatgtcgggcaggatgatatggaagccggcgatgtgcgtgccattctgggcgctgacaaaatcatcggcgtatctgcgcataatgtggaagaagcgctccgcgcagaacgccatggcgcggattatctgggcgttggcgctgcgtttacgaccagttccaaaccggaggcgggacacattgatgcggcgacgatacgtgccatctgcgagacggtaaagattccggtcattgcgatcggcggcatcaaggaggagaatcttctgcagctgcgcggaaacggtctgtgcggcgttgccgtgatcagtgccatttttgcacagaaggatatcgaggcggcgacgagacgtctgcgcgctctggtagaggaaatggcgggggatcaggaatgaagggggcaatttttgatatggacggcacgctgctagactccatgcaggtgtgggttcacgtcggcgagcagtatttgcggaaccggggaatcgaaccggaagaagggctcggagatgtgctttttcccatgagcatgcgggacggagctgtgtatgtgaaggaaaggtacggtttgccggattcccccgatacgattgtgacggacatggacgcgattgtgtttgcggcataccgggatgaggttctgccgaagccgggcgttgcggtatatctggaatcgctcaaaaagcggggaataccgatggcggtcgccaccgcgacgaaccggccgatggtggaggcggcgctcgcgcggacaggacttgccggctattttaaacagatttttacctgcacggagatcggcgcgggaaaagaaaggccggacatctatctggcagcggcaaaggcacttggtacgcacccggcggacacctgggtgttcgaggatgcgctctatgcgattaagacggcaaaggcagccgggttttatacggtggggctttacgatgagacgagcagaaatgatcaggaggcgattgccggcctggcggactgctatgtgcgggagattcaatctgttcccacacaagactgtacttgagaatgtaatgctggcgcctgttcatgtaaaaaagatggagaaaggaaggacagaagctcttgcaaaagaacggatcggaaaagtcggacttgcggacaaggttgtctttatggcggatggaagaattcttgaggaaggaaagccggaggagattttttccaatccgaagacgccagaggcaagacagttcctgcggagcgttctgtagtagggtgatgaataaatttgtgatgagacaatctttgctgctgcttttgacggcaacgatctggggcgttgcgtttgtggcgcagagtgttggaatggattatatcggaccgtttacctttaacgtagtgcggaatgtgattggcgggctagtgctgatcccatgtattgcagtgtttcatagaacaggtgcaaaggaagaggatgccggaaagacaccgggaagccggaaaaatctgctgcttggcggaatctgctgcggggtcatgctttttgtggcaggcaatctgcaacagatcggaatacagtatacaacagtaggcaaggcgggatttatcacagcgatgtacattgtgctggtgccgatattaagtatttttttaggaaaaaaggcgggaatcaaaatctgggccgctgtggcgctggctgtcgcggggttatacattttatgtatgacagatggcagcttttccctgcagaagggagatctgttcgttctgctgtcggcatttgcattttcggcgcacattcttgttattgattattttgcgccgctggcggacggtgtaaaaatgtcgtgcatccagttttttgtgtgtgcactgctgtcggcggtctgcatgtggctgtttgagaaaccggatatgggagcggttctgcaggcgtgggttcctgtgctgtacgcaggtgttttttcctgtggcgtggcgtacacactccagattgtcggacagcgtggcatgaacccaacggtggcgtccttaatcctcagcctggagtcggtaatttcattgattgcaggctgggtaatattagggcaggcgctctcggtacgtgagctttccggctgtgtgctgatgtttgctgcaatcattctggcgcagcttccggagcggaaacgtggcgcgtgatttcctgtgattttgcaaatttagcgtagaagtgccagaaaaactgtgatatgataaaaaagggaaaacgccttcggattccgaaggcgttttctgttacagagacattttaggacacgaaagctggtaagagaatgatacgcagagcggtactgcaggatatttctgcattgatggatatatataatgaagcgattcttcacacgacggcaacgtttgatacggaagtcaaaaacatggagaaccggaaggcatggtttgcggagcataacgggcgctatgtcatttatgttgatgtggaggacggcaaggtggcgggatatgcgtcgctttcccgttacagggaccgcaaggcatttgaccctgcggtggagatttcaatttatgtacacaaggattatcgagggcgtggcatcggccgcagcctgatggagaaagtgcttgcctatgcagcagagtgtgacgagattgacacggtcatctctttaatcaccagtgagaatgcggcgagcattcatctgcatgaggtgtatggatttgagtattgcggtcagattaaaaatgcagggacaaagtttggaagaaaactcagtctgaatgcatatcagattctatatgacaggtagagaggatatagggcaaaagctatgatgaaatattttatgaccgataatcaggtgatacatgaggaggagaagctgcaggacggcgtgtgggtgcggatgatcagtcccacgcaggaggaatgtgaggagattgccgatgtgctgaatgtggatatcgacgatatcaaggcagcactcgatgaggaggaaagctcccgtatcgagctgcaggacggatatacgctgattctggtggacgttccgacgacagagatccggcacgataagcagtcctacacgacaatccctctcggcattatcttaacgcaggatgtgatcgtgacggtgtgcacggaggatacgccggtgctcaagaattttgtgatcaaccgcgtgaaggagttcagcacgaaaaagcgcctgcgctttgtgtaccagattctgtaccgcaccgcgacgatctaccagaccaatctgcgcatcattgataagcgccgtacggagattgaggagcggatcggacaacacaccgaggacgtggatctgattgatctgcacgaactggagtccacgctggtctattttgccacatccctgcgtgcaaacggcgtggtgttagaccggctgacgcgctataagagactggagcagtacccggaggatacggagcttctgggggatgttatagtcgagaaccagcaggcgatcgagatgacttccatctaccgtgacatcatcaacggtaccagagaactgatgtcctccgtgattgacaaccgcctgaacaacgtcatgaagtatctgacctcaatcacgattgtcatggcgattccgacggtcatttccggtatctatggaatgaacgtggatgagcggtggatgccgtttgctaatacgccgcacggatttttgctgatctgtgtgctgactctgttgatctgcattatcacgatgctgatactgcgtaagaaaaagatgctatagaacaagcggcgggagaatctgccgcacgatcgaatcacgggcggcgcagcagagcagctgcgcggagagaagagtataatgaagacaaaaatttacggaaccatcggaccagcatgctgtgatacagagatgctggttcatttgtttgaaaaaggaatgacaggaattagaatcaatctgtcccatgcggatctggaagaagcggatgcgtggatctccggcatccacagcgcatggagccggctgcatgacggaacgccagagattctgattgacttgcggggaccggagctccgcatcggtacgcttggggcagaacgtcttttaaaagagggagacggtctgagccttgtggcggacggacaaaacaatctgtttgatccgacggagattccggtgccgggaacgctgcttgtggcgcttgcgcccggacaggagattttgctggacgacggcaggattgcattaaaagtagaagaacaattccgctgcggatcgtctgtcgcggtggaatgtaccgttgtgcggggcggcgtcttaaaaagcgggaaaagtatcgcggcgcccggtgtggagatacagacaccgacgctgacggagcgtgattacaggaatcttgccagagtaaagcagtgcaggatcacaggggtcatgcttccattcgtgagaaatcaagaagacttaaagaacttaaaagaagctttaataaatgaggatgccggggacatccgcattttcgcaaagattgagaatctgcagggaatggagcatctgggggagctgttgccacactgcgatgagatcgtgatcgccagaggagatctggggaatgcgatgcccctggcaaagcttccgtgcgcgcaggaggagattgcggctcagtgcagaaagcacgggcgcgcgtttatggttgtcacgcagatgctcgcctccatggagcaccgggcggtgccgacgcgggcggaagtgtccgatatattccgcgcggtgcagcagggcgcggcatctgtgatgctgacgggcgagaccgctgtgggagaatatccgctggaggcgatggaggttctggtggatacggtgcgggaagcggagtggtatctggaagaacgcagataaaggggcataaaatgtcatttatccagcatctttttgtattcgcgaggactctgtcctacatatttccggaagaggcgtgaaaaatagcccatatcggtgtagccgacggcgttggatacttccgcaacgctcatgtccgtggtgttaaagtaacgcagcgaggcgagaatgcggtgcttgttgatataagttgtgagtgtgtcgccgacttcctttttaaattcgctggagaggtaagaagcatttttgccaaattccgaagcaagcgtggcgagcgataattccgaggacaggtgctggttgatataattgaccacgcttcgtatcagataggaataattgtcataggtaaagtttttcacgagcaggcagtatttgcgtaccatttcataaggaagatgctgcagttcctgcgcctgcacggtttcgttaattttaagctgaaaggtatgcatctgcttaaagatataggcgggatgcacctgtgtgtccatcattttggcagacagaaaagtgttgatgtaggagagatattcctttaactgggagagtggtgtctcggaaaaagaaaccgcaaaattcaacagggatttcatgctttcggaggaggctgtctgatcaccggtgatgacagcatcgccacaggattttatgtgttcggcgaggtttgccatataatcggaagtaaatttgtgaatccgttcctcgttaaagtcaacttcgtgctgttcggaggtataattgatatactcgacgtgattggctgcaaacccggggataaatgcagtgatcagatgctgcagtgtggtgatcagactctgcatttccacgacgggaagattgtagtagacctgctgcatgctggatgtatactgtggcggaatgccgttctccttcatgatgcggttgatgacagccggagttgcaggttcggtacggaacggcatgaagccaaacatatcgggatgctcctcgtttgtaactgtgataatcagattgtaaaagcccagaacactttttaacacgataatctgccaggcatcctgttcgggagacagggagaagatggcagaatttgtggaataggttccccagaccattttgcgaagccccatgtccagccgctccagatcggagtagggataatgcatcagaaaagagtcgactttgtaggtgtctaagatggtctggcggatgaccggaaaacagtcctccacggaaatatagggcaatgccataagaatcctccttgcttgatccaggaactgttagctgcaaataacaacgtgaaaaaattttagtacaaaataaatataacacaaaaataatccgtgtcaaacaaaaaaaggcaaagtacagggaaagggaagttgctataataaaaccatcaaagagaccgcatggggcggtctgctacaggaggcgcattatgggaaacacaaacaccaagccgtttggcgtaaaggacaaaatcggttacatgtgcggtgatattgcgaatgattttacattcattttcgccagcagctatgtaatggtattttacacaaaggtcatgggagtctctgccggtatggtaggtaccatgttcctgcttgcaagatgtctggatgcatttaccgacatcggaatgggacgcattgttgataacagcaagccgaccaagaacggacgcatccgtccgtggattctgcgtatgtgcgcatttgttgcactggcatcgttcatgatgtaccagtcatttctggtagatgcaccgtatgcggcaaaagttgcttacatgttcatcacttacattttatggggatccattttctatacatccgtaaatattccatatggatccatggcatctgttatttccagcgagccgaaggaccgaagctccttatctgtgttccgttctctgggcggtacgctggcaggtatcctgatcggtatgcttgcaccgatggtggtatattacaccgatgaggcaggaaacaaggtcgtatccgcgtccaaaatttccatgatcgcaggaatcttttccgtacttgccgttatctgctatctgttatgctatacgctgacaacagaacgtgtcgcgtatgtaccgaagccggatgtccagaagaagacgttcggacagacggtttccgcactgttttccagcagatcgctgatgggcctgattctctcggcagtgctgttgttgttggcatctttaatgtcccagggcatcaaccagtatctgtttgcagattactttaagaacactgcagcattatccgtatattcgctgctgatgcttccgtgcgtgcttgtactttccgcagtgtccacaaagcttgccgtgaagtacggaaagaaagagtgcagtcttatcggaatgtttatctccgcaggattatattttattattggcgtactgcatgtaaagaatgtatggctgttcgtcggactggcattccttgccatgatcggtatgtatttcttccagatgcagtgctgggcactggtaacggacgttatcgatgacatggaagtgaagaatcacaccagagatgatggtaccgtatacggtatgtactctttcgcaagaaagatcggtcaggcaattgcgggcggactttccggatgggcacttggctggatcggttatgatgagctggcaacaagccagacgcaggaagttgcaaatggaatctacaatctgtccaccttcttcccggcaatcatctatgcattatgcggactggcactgttacttatatatccgctttctaaggcgaaggtagaggcaaacgtaaaagaacttgagtccagaagaaaataatataggcttgttaaggggctgcacattaagcgtgcagcccctttttcgtgcagctcatgtgataagcagcattataagaagcacatatgcagatttccgttggaaatgcagatggaatattcgttggagaaaaatgtgagcatttctaccagttggatgtttgcatcagattccgtgtctcttccacgttttgactatccgacgggtgcatgtccggcacaccggagacaatgggcggacctgacccgcggattgttccaaacttggaaagacacggatcatcgaagatgcaaacatctggctggttagaaatgccatattttttgaccgaatttccatctgcatttccaacggaaaccgcaaagtgcgagttccttataatgctacttgtcaaaatccagcttcacgaaaagggacggctgcctctttttgggcgtatttgttaaggaaaggtcaaaataggtaggaagtccgttcaaatagatagaaagttctatctatggaaaccgatattttttacaaacattggaagacatttttgactgaatgtatatttttgcaattttcaatttgtaaaaaggcggaaaatgtgaaaaaaatcacaatctatgcatgcatattgcacaaaaacagaacgcaaaattagaacttttgacgaaattgacatttaatgggaaacttcataaaataggaacacaaaaaaagagaaaggaagtggtaatacggaggagctatcaaagcagctgatggaagagctgaactgtgagactgcgttcacgatccctgtttttggcgggatccctgtggcagagtcggtcgtggtcacatgggtcatcatggcagtgctgctgctcggctcgatcattcttgtgcgcaacctgaaagtagagaatgtcggcaagaaacaggttgtactggaaacggtagtgggaggcttatacaacttcttttatgatctcctgggggaggatggaaaggggtatatcccatatctgatgaccgtagggctgtatatcggcgtggccaatatgatcggtctgttcggtctcaagtctccaaccaaggatgtgggcgtcactggtgctcttgcactgatgagtatcgtcctgattgaattttcgggcgtacataaaaaaggcgtcaaaggctttctaaaaagctttgcggaaccgatcccgcttatgctgccgatgaatattctggaaatatttatccggccgttatcactgtgtatgcgacttttcggtaatatcttaggcgcattcgttatcatggagctgatcaagatcgtggcaccgttacttgtgccggtaccgctcagcctctactttgacctgtttgacggattcattcaggcatatgtatttgtatttttaacatcactttttattaaggaaaccatcgagtaatcaaatcgaaaaagaaaaggagaacattattatgacatctttaatcgcaatcggagcaggaatcgcagcacttacaggtattggagcaggtatcggtatcggacttgcaacttccaaggcaacagacgctatcgcaagacagccggaggctgacggaaagatcacaaaggcactgttacttggctgtgcactggcagagggtactgcaatcttcggtatggttgtagcaatcttaatcatcttattcttaggctaaggaaaggttatggtagagtatgcagttacttagaatcgactggaatgtcatctttaccatcgtcaatctgatcgtattatatctggggctccgcaaatttttaatcggaccggtcacgaaagtgatggatcagcgcaagcagctgatcgaagggcagatggcggacgcacgccatgtaaatgagcaggcaaacgagctgaaagcgcagtatgaggacgccttaaagcaggcgcatgaggaatcggcgcagatcgttgagaaggcgagaaagagcgcacaggcggagtatgagagccgtatggatgcagcggatacagaggcgcagaaaattattgccaacgcgcacaagtcgattgaccttgagcgtgagaaaaccgtgcaggagctgcagtcgcagattgcgggacttgccatggcggcaaccgctaaggtattgggcgacacggatcaggcagcgcagaacaagcttatgtatgaacagtttttggcgaaaacgggtggtttaaatgacacaaacagcaaataattacggaacggttctttttgagctgggcgtggagaaagagactgtggaagagatgaagcggattttctcactgactggcgaattgccgcgcgtgctggactgtccggtggtatccggcagggaaaagcacaggctgatcgagcagctgtttccgaaagaggtctggaatttcttaaaagaaatgtgcgaccacggaaacgtatcggagatggaggatgtctttaaagcgtatacgcgctgctacgatgaggcaaatggaattttaaagaccgttatgtactgcgcgggtacaccggatgaggagcagcttgcacagattaaagcatatctcgccgcaaagcaccacagagagacggtggagcttaccatctgcacacagccggaactgatcggcggatttgtgctggagacgggagatctggtggaagattacagcgtccgggggcggatcaagaatttagaacaaaaattgacatggaggtgatgacgtgggttccataaattcagaggagattatctccatactgaaaacagagatagaaaattatgatatggtgaccggtgagcaggaagtcggctctgtcatctgggtaggagacggaattgcgaccatctatggcattgagcatgccatgtatggtgagatcgtgatcttcgagaatggcgtcagaggtatggtgcaggatatcaagcgcgatcagatcggctgtatcattctcggaaaagacaccggcatcaaagagggcacaaaggtcacacgcacgaagaagaaggcgggtgttccggtcggaaatgcctatcttggaagaattgtaaatgcactgggagcgccgatcgacggcaagggagatattccggcggacgattaccgcccgatcgagcaggaagcgccgggcattgttgaccgtcagtcggtcaagcagccgctcgagaccggtattctggcgattgacgccatgttcccgatcggacgcgggcagcgggagctgattatcggcgacagacagaccggtaagacgtcgatcgcagtagataccatcttgaaccagaagggaaaagatgtgatctgtatttatgtggcgatcggtcagaaggcatcgaccgtagcaaagcttgtgaatacattgacgaagaatgatgcgatggactactccatcattttatcatcgacagccagcgagtcggcatcgttacagtacattgcaccgtatgcgggaaccgctatggcagagtatttcatgcatcagggcaaggatgtcctcatcgtatatgatgacctctccaagcacgcagtggcatatcgtgcactgtcccttttgctggagcgttctccgggacgtgaggcttatccgggagacgtattttatctgcattccagactgctggagcgttccagcaagctttccgatgagctgggcggaggttccatcacggcgctgccgatcattgagacgcaggcgggcgatgtatccgcatacattccgaccaatgtgatctccatcacagacggtcagatctttttggagagtgatctgttcttctcaggtatgcgtccggcagtcaacgtcggtctctccgtatcccgtgtcggcggtgcggcgcagaccaaggcgatgaagaaagcgtccggtacgatccgtattgatctggcgcagtatcgtgagatggaagtgttcacacagtttgcatccgatctggacgacatgacaaaagagcagttacagcacggaaaatgcctgatggagctgttaaagcagccgctctgccatccaatgagcctggcggatcaggtcatcacgctggtcgctgccaacaagcgtctgatgctggacgtagacacggcaaagacgaaagaattccagctgggtatgttagattacatccatgtacagcacgcggagcttgtgacgaagatcaacgaggaaaaagtgctggatgatgcgattacggagcagattgtagaggcggttaaagaatataagagcaggtgatagagcatggcaaataccaaggaaattcaaaagcgaatgaaaagtatccgggataccatgaagattacaagcgccatgtatatgatatcctctgccaaactgcgcagtgccaagcagaagcttgagcagacggaaccttatttctatgcacttcagggttccatttccagattcctgcgccacattccggaggtgcagaaccgctatttcgaccagaagaaggagattccggaggaagaaaagcggcgtggatatatcgtgatcactgcggataagggtctggcaggagcatacaaccacaacgtcatcaagatggcgcatgagcttttcacgcagggcgagaacaataagctgtttgtcgtcggcgagctcggacgccagtattttgcgaaagagggtctcgcggtggatgcggagttcaagtataccgtgcagaacccgtcgcttcaccgcgcgcgtgtcattgcggatcacgtcatggatctgtacgcggaaaatgagcttgatgaggtatatatcatctacacaaagatggaaaactctttttctatgaatgcggagaagatgaaacttcttccgcttgtgaaggaagacttcctgcatcctgccccggcggatatctaccaggaggagatccgggtggagtcatccatggaggcgattctggagcatgtagtaccgaactatgtcaccggatatatctactgtgcgctggtagagtcgtttgccagcgagcataattccagaatgatggcaatgcaggcggcaacggacagcgcgaaggacatgatacagacgctgtcgatcgagtacaaccgggtacggcaggcggcgatcacacagcagatcacagaggtgagcggcggtgcgaaagcgcagaagaacaagaaaaagaaataaagcggaagggagcttgtatgaagaaaggtaaaattgtacaggtcatgggacctgtcgttgacgtagaatttgaagataatgaccttccatatattaaagatgcgcttgaagtggacaacaacggaaagcgctgcgtgatggaggttgcacagcacatcggcaataataccgtccgctgcatcatgctcgcggcaagcgagggcttatgcaaggatatggaggttattgccgagggcggcggtatcaaggttccggttggaaataagaccctgggcagactgtttaacgtgctcggagatacactcgacggaggcgaaagccttgacggtgaggaacactgggtgattcacagagatccgccatcttttgaagaccagagcccggtcgttgaggtgcttgagaccggtattaaggtcatcgatcttttggcaccgtatgcaaagggcggtaagatcggtctcttcggaggtgccggagtcggtaagacggtattgattcaggagctgatccgcaacattgcgacagagcatggcggatattccatttttaccggcgtcggagagcgttccagagagggaaatgacctgtggtctgagatgaaggaatccggcgtactggataagacggcgttagtgttcggacagatgaacgagccgccgggagcacgtatgagagttgctgagacgggacttacgatggcagaatatttccgcgatgaggagcatcagaatgtacttctgttcatcgataatattttccgttttacacaggcaggatctgaggtatccgcgctgcttggacgtatgccgtccgcagtaggttatcagccgaccctggcgacggagatgggcgaactgcaggagcggattgcctccacgaagaacggatctgttacttcggtacaggctgtttacgtgcctgcagatgacctgacagacccggctccggcgacgacatttgcacatctggatgccaccacggtactttccagaaagatcgtagagcagggtatttacccggcggtagatccgcttgagtccaactcccgtatcctcgaggaggacgtcgttggaaaagagcactatgagactgccagaagagtacaggagattttacagaagtacacagaactgcaggatatcattgcaattctcggtatggaggagctgtccgaggaggataagctcgtggtataccgtgcaagaaagatccagaagttcttatcccagccgttccacgtggcagagaactttaccggcgtgccgggcaagtatgtgccgcttaaggagacggtaagaggattcaaggcaattattgacggtgagatggatgagtatccggaagcagcgttcttcaatgtaggtacgatcgatgatgtgatcgagcgtgcgaaggagatgggggcatgaatacatttagtctgaaagtgattgcctgtgaccgtgtcttttttgacggaagatgtgagcaggtcgttctgccgctgcatgacggagagaaagcaatccaggcgcatcacgaaaatatggtgtttgccgttgagatcggcgagatccgcatcacggacgaaacaggcgaggagatcgtgggtgtgacaggcaccggatttgcacagatcatcaataaccgtgcaatggtgattgttgacacctgtgagtccccggaggagatcgatgtgcggcgtgccgaggaggcaaaagagcgtgcacaggagcagctccgccagaaacagagcattcaggagtattatcgttccaaagcatcgctggcgcgcgcgatgtcgcgcctcaaggtcgggaaaaaagaccgtccgaccggatattaagaagaaaaatggtcttgtgcaaggttccggcgggtctgagagagaaaaaacgtctctccagacccgccgggaccttgttattatgcgcgtgggaagaaaaaagggctgttcgcgggtctgggaatgaaaaaccagcccgtgagacccgaaaagagattagtttcgggtctgggagaggaaaaaggtgttgccagacccggcggaagccaaaatgcagccatgtaagtcaaaaaaatagaagattgtacgcaaaaacgggtctacagagagaaaaagtcctctgtagacccgttttgatcttatgcacaacatcagcaaacaatgattgaccaagaaagctcctgtgggtgcatgtgagactcagccctgcagcttgccagccgatacaagtattaacgcacatgccgttgcaacttacttaagccccactgtagcctgtaatgcaacttactagccagccagcttatgcggtttgctcatcggtgcagattgcttccccgcgctgcttacagtacgaagaatgtacaggttgccggtgcaagagtcactgttccggcttcctgtgctgccggagtgagttccggaagagaattgccggcacccagaacaagtggcttgccatttaaagtcatgacagcggcacgcacgttgccgccctcgccggcgagtgtgtagcgctctgcgctcttcggaagctctacggtggttgtctctgtcagcgagttgttgatcacaagatatacaacgccctcttttccatctttgcgggaatgtgcgaagacatgtgcgccctcgcggagtggctctgcggtatcgtaaacggtcgtacccatcaggcggttccacaacaatacggcaaaatagttcgggcgcggatcaaatacttcgcgggccaggaagccgtagtcggaagaagccagtgtattgtggaaaataacgccgtctgtgatcgctgcgaatccagcgagctcgtttaaggtacggaaaacatccagatacgtggaagcccatgtatcaccgccaccgcctgcgtcgccggactccgttacccacatctcgccgcccgggcagtatttgtcgcggagtggagcataggtgcgcgcacagtttaatgcaacgtccagatacgcctcggtatgggcggtatctgccagccagtgtccgcttggcatcacggaagcaagacgctcggatacaccgttgtaataatggtagctgaatacgtccaacggctctttggtgtcctctaacaggtcggttgtggagcagttctctcttacaagctgctcgataccaccactcttgctgttgtcatcaccgccattgatggtaagaccctcgccaacactgctcggtccgatacagatacattccggatagttggcgcgtacccacgcgaaaaacagatcctgatcgcggtggtaatcagccggtgtataaccagccgggaagccggtatcctccatcatgttcggttcgtttgcgaactcggcgccgtcgatcggtacgccgtgttctttgctcagacgaaaaatcttctccgcctcactcggattccacggttcctctgcggaatgcagacccgggcagttcgcaacggaaatcatcagtttcgcatcgatcgcttttacgaagtcgagcacaccaatccactgctcctttgtcaggacatttaagtagccctccggagcaataccgcctgttgcattgtcaaaatcatagtaagtcttggttgcccaggtgccggacacacgcacccatgcggttccgagctcctttgcgagggagcggagcttctcgttgtacagatcgatcggtgcgtatacctgcatcagatccttgtacattgcagcaatgccgtctgcgctcggagcgacatggaattcctcggttcctgcaacctgctccggtgtgtacgctttccagaaggtgccgccggttacctcggcgaattctacattataagacatcaggcgcggatttacttcgcgcagcgcctttaaattctcgggaactaattttacaaactgtgccatagaaatcattctcctgttcgtttttatttgccggtgatccggatccccgtatcacctttgcataaaaacagcgtaccacaaaaattgtattgtgtatgcaggaaaacaactatttacaaaaattgtgcaaaaacaggacaaaatcgttcccgcccttagcgctcaaatctgccgcttgccccgcacggaagcaccagaccgttgctggaaaccggcagaccgatttcatctgcggcgatatgaccaccgtgtttttttaagacggtattcatcatatagctgagcactgccggctgaagaccagtggtgtaggagttgatcaggaaaaacagaggatcgtccgacagcaactgctcacagagctgcaccagcggatagatggcgtcctcgattttccagatctcacccttgggtcctcttccgtaggaaggcgggtccataatgatcgcatcatagtggttgccgcggcggatctcgcgctcaacaaactttacgcagtcgtccacaatccagcggatcggggcatcaccaagaccggaagagacggcgttttccttcgcccaggtcaccattcccttggaggcatccacatgcgtgacgctggcaccggcagcagcggcggcaatcgtggcaccgccagtgtaggcgaacagatttaacaccttgatcggacgtccggcgctgcggatcttttcggaaaaccagtcccagttggcagcctgctccggaaacagtccggtgtgcttaaaactgaacggctttaagttgaaagtcagcttgccgtaatggatggtccactgctggggaagatcaaaaaattcccactccccgccgcccttggcgctgcggtggtaatggccgttcattttgcgccagccgcgctcggtcttcggcgtgtcccagatgacctgcgggtcgggacggacgagaagataatctccccagcgctcgagcttttctccttttgagcagtcaatgacttcgtaatctttccagttatctgcaatccacatagcaatctccattcctgtgtacttctaatttaaaactataacaaatatataccacaagccagcagagggcaaggaaaaagtaaaaatgtctgcctgcgggcagagaaaaagccttcgccacggcgcggcgcaggcattaacggatgcggatacagcatccggagcaggaaaaagcccataaaaagccaataaaaaaccggtagaaaaatatctaccggttcaaaactgcgcagcccaaattgccggctgcacgttattttttacgccaggtggacggcatgaacagaatcatgagcgggaaaagctccagtctgccggcgagcatgtcaaaaatcagcacaaccttggagagcggcgagaagatcgaaaaattctgcgccggtccgacacggtttaagccaggaccgatgttgttcagacacgagacgactgctgtaaagttcgtggtaaaatcgaactcgtccaggctgatgataagcgttgacagcatgagcaaaataaagtaaatgaccagaaaaacattggtagagcgcagggtgctgtgttctacgacatgtccgtccatgcggatcttgcggatctcgcgggggtggataatcagggaaagctctttgcggatggttttgaataaaatcaccagccgggatactttcataccgccgcctgtgcttcccgcacatgcgccgacgaacatcagcgtcacaagaatcgtctgggagagcgcaggccacatgtcgaagtcggcagtggaatatccggtggtggtgatgatcgcaccgacctggaaaaaggcattccgcagcgcgtccctggtatttgcgtaaagcgggcgtatattataggtaatcattccgacagaagcaaagatcaaaaagagataccagcgcacttcctcgatgcggaatgcatccttgattctgcgcgataaaatacaaaaataaaatgtgtaattgataccgcttaagatcataaaagttgtgaccgtgttctggatagcaggcgaaaagcttgcaaagctgtcgttacggaaaccgaaaccaccggtgccggtcgtgccgaaactcgtcagaagagactcaaacagcggcatgccgagcgcacacagaatgacaatctcaaggagcgtgatggcaaggtaaatgccgtataatattttcgcggtatccttgatgtgcggaaccagacggctgacggaaggtcccgggctctccgccttcatgaggttgatcgtagagccgcccatcagaggcaggatcgacataataaagacgaacacacccatgccgccgatccagtggctgaaactgcgccagaaaaggctggcatgcgacagggactcgacatcagagagaatacttgaaccggtcgtggtaaaaccggagaccgtttcaaacagggcgtctacataatatggaatgtcgccgttccacacgaaggggatagcgccgaaaatactcataacgatccagctcaaggcgacagtaacaaacccctcccttgtatacacggtcgaggaagacggttttttatgtgtgaaaacaatccctaaaaccagacagattgcagcggtaatgacaaatggaatgccggcctcctcctgatagatcagcgagaccagcgccgggagcatcagaaacgcgctctcaaattgtaaaatatagcccagaatatataaaaccatggaataattcattgcaggttaatcctccagaatctctttgatgtcggagatgcggtatccggaaatgacgaccagaacggagtctccggcgagcatcatatcctgtccacccggcagaatgaccttgccgttgcggtagatgcagcagattaaggtgttcttccggaaattcagatcctgcagcggaatgcctgcgacggcagaattctccttgatgatgaattccagagcctcggcttttccgccggcaagcttgtaaagcgtctccacgttgctgttgatggaattcactgtggagcgcacatattttaaaatgtaatcagcggtaatgacacgcggataaataatacttcccagattcatctcgttgatgacggagttaaagctgctccggttgatcttggtcaccgtttttgcattggagacatcgttggcgtacagcgacagcaggatgttttcctcgtcaagaccagtgagagctgcaaaaccctgcgcctgctccaagccctcctcggacagcagatcctgatcggtggcatcaccgcagatgattgtcgcctccggaagcagctcgcttaaaacgtcgcagcgggacggattgatctcgatgatcgtcacacggatgcccgactggatgagaatctttgcgaggtaaaaggaaaccttaccgccgccagcgagaatggcattgccgacgcggttcttgacgatgccgatcttacggaaaaagtcaatggcgttgcggcgctcggaagcgattgcgacggtatctccggcgcggaattcaaaatcaccgttcgggatgatgacctcgctgccgcggatgacggtacacaccagcacgttgctgtgcagggtctggtgcagattgaacagctttaaatgaatcagcggggaattctcgctgactttaaagtgaagcagctctacatgcccctttgcaaaagaatccacacggatggcggaaggaaactgaaatactcttgaaatctcgttggctgccgtcaactcaggattgataatcatggcgagcccgaattcctttttcaggaaggcgatctcgccgttgtagatcggattgcgcacgcgcgcgatggtctggcagtggccggtcttcttggcaatcacgcagcacagaaggtttttctcatcatctccggtaactgcgattaaaagatcggcagtggcgatgcctgcctccagcagtgtcttatggttgatgccgttccccacgatgcccatcacatccagacggtcggtaatatattgaaccttttccggcttttcatcaatgacaacaatattgtgatcttcgttgctgagctgttcgacaagcgtaaaaccaacttttccacagcctacgataataatgtccatagaaatctccttaaagaataatcaaagacattatagcatatacaaattgtttttgggaaaaaaagcgtagaaattggcaaaatcttaatgataaaaacaattttttcaaggaaacgcccgcgtggacagttcttgtgttttaaatgagggtacgttacaatgagtgacagagaactaaatgacaggagaggaaagaggagtttatgctggaacaattagtggagtgtgagaaccggcttttagaggaacagagacggttcaatgagttactgcttgcctggcggtccggggatctgggggacgatcttacacggatgaagattgagcagatgcagcgggaagtggatgcgctgggacgacagctgacagcgctgcgcacagtaattgcggcacaggcagaccgcgaacgggcgggataccgtcagggggcgatgccgaaggcggcgtatggatggccggcgtatggacaggcggtggcagcggcgcagtcgtggaatcagacaatgccgcagccggcagtgcagacagcggagacgggaaatccgataccgccggcgccgggcgcaatgtcacagtccgcgcgggagacgggaaacccgcagcaggcgtatcagcagacaccgccgcggccggtggcagcacaggcgggataccagcaggcatccgggaagcaggatctggaaaaaacgatcggcagggcgattctgccggtctgcgctgcaggactgatcttcctgagtctggtgttttttgcgatgctggtgctgccgtatcttagccagggagtaaagatggttctgatgtataccgtcagtgccgcgatcacgctggcaggaggaattcttgtggcacatgaccgcaggaataaagcatttcttgggctgctgggctgcggcatgggagcgtggtatctctcgctgtttttaagtgatttttatttccatgcaataaacgacggcatactttatctgggactgctggtgtgggcggtggttctgtgtgtgctgtcacgtctgcggtcgaatctcttccttatcatagggcagattggtgtgggcatctcattgattctcggcgtgctcatgtgtaactggacggaggatgcggaaaggtttctgattctttctatatattatgcggtaacgcagaccatctttttcgtgtcccacctgcggagagaatattaccgcaatgcggtgaatcttgtgtcgtggagcatcgggctgctcattctggtgcttggagcagctgcttcctatacagaaggctccgctgcgggaaacgtgtcagtggtattgcttcttgcgcttgcagcggttccggtactgcttggcgtagccgcggcggaaatggacgagaatggaaaactgcttggcggtattgtgggggcactgtgtatcatcattttttgcggactgtttttgaaccggtttaccggagcggcgctgctcttactggtatttggcattgcagttctggcgctgctggaattccggcggcccggggatctgtccgcggggacggttctgcttgaggtggctgtttttgcgcagatgttctttgcgggagttgccgcgccgtatttcggagagtatgtatcgacgggacttctggcggaggcgtgccttctgtacggtttcctgcgaaaaagaaaagcataccgggcggctgcgctcggctatggcatcctgctgttgctgatcccgatgaacgggggcatgagaacagtctggggactggtattcttcggcagcgcggtgctgctgattgggttctgcagggaacagtatgaaacctggatgaagatctgtggttatctgatgtttttggcattcctgtcagaaacggcggtgtggggaacggatctggcagcggtcgcagatgtttacctgagcgatctgatctgttttatgccgattgtgctctgcaatattctggcggcgaaagttccgctgtttcgcagaaatccaaagacgggagaggaagaaaaagcattcgcggcggtaacgatggccgtgcaggcgctccttattgcagcggttctggttctgatgggaaaaccggacgcgccggtgcttcaccttatctatatgcttttgggactggtgctcgtgtgcaccaatacctacagcctgctgataaggaaggacggagactggtggggaatttacgtggcgttaaagctgctgctgtttgcatcggtcgcactgcactcctatggggtgcccgtgttcgtgaacgatgtgacgggcattgtgattgcgttctgctgtatcgtggcgggatttctggcggaaatgcggatgaagagaaaatataaggcgctgcgggtctgcggactggttctggtgctgctgtgcgttgtaaaactggtgctcgtggacatccgctacgacaatgtgctgctccgggcggcgggattttttgtcggaggcatcctttgctttggtatcagtcttgtatacaatctggtcgacaagtggatggggcggcgcgaaaatgcaaaaaactgaaaaaaatccttgcaattcgcggtttcatcgtgtatactatgcattgctgtgacattgatagcgttgaagcgtgaggttgctgcagagcattgcaggttttccgtggagcgaatgtcaagttaggaaactggcgacaagtcactgtatcacgaatagaatttgtccgaaggacagagggatggcgtgtaggaagcgcgggcttctttgtgggcgtgagtccatgatacacgcgggtatgtgtgcagtcaccgcttgtcgtacaaaaagcgattacatcgcttgtaaaagtgcgaaaaggaggcgactttttttatggcaagtcaagtaatgagaatcactctgaaggcttatgatcacaagttagttgattcatcagcacagaaaatcatcgaaactgtaaagaagaacggatcacaggtgagcggaccggtacctcttcctacaaagaaggaagtagttacaatcttaagagctactcacaagtacaaagattcccgtgagcagttcgagcagagaactcataagagactgatcgatatcgttacaccgacccagaagacggttgatgcattatcccgccttgagatgccggcaggtgtttacatcgatatcaagatgaagaataaataatttcttcatcccagacaaatcaatgatttagttaatatcctgaagggttttatatagaagtaatgcaggcggtgaaaacttcccattccacttatatggactttctaggatgaacggttccgctaccccacatggttgggcatgaagcgttccgctgtagagaaaacaggaggtaaaagtatgaagaaagcgattttagcaacaaaagtcggaatgactcagatcttcaatgcagacggtgttttagtaccggttactgtattggaagcaggtccatgttctgtaacacagatcaagacagtagagaacgatggatacagtgcagtgcaggttgcatttgctgacaagaaagaaaaggttgtcaacaaggatgcaaacggcaagaagcaggtagctcacagacatggtgtaaacaaggctcagatgggacattttgcaaaggctggcgtatccggcaagcgttttgtgaaagagttcaagtttgagaacgcagcagattacaatcttggcgatgtgatcaaggctgatatctttgcagagggcgacaagatcgacgctactgcaatttccaaaggaaaaggattccagggcgctatcaagagattgggacagcacagaggtcctatggctcacggttccaagttccatcgtcatcagggttccaacggtgcgtgttcctcaccgagccgtgtattcaagggaaaaggaatgccgggacacatgggaagcgtacaggttactacacagaaccttgaaatcgtaagagttgacgcagagaacaacctgcttttagtaaaaggtgccgtaccaggtgctaagaagtgtttagtaacagttaaagaaacagtaaaagctggtaaatagtgctcgaataggaaaggaggaactaaacgatggctaaagtagctgtttataatatggaaggcaaggaagttgacagccttgaattgaacgatgctatcttcggagtagaagtgaatgagcatttagtacacatggcagtccttcagcagcttgcaaacaaccgccagggaacacagaaggctaagacccgttccgaagtacgcggtggtggtagaaaaccatggagacagaagggaaccggacatgcaagacagggttcaaccagagctccgcagtggacacatggtggcgtagtattcgctccggtaccaagagattattctttcaagctcaacaagaaagagaagagagcagcattaaagtctgcacttacttcaagagttgctgagaacaagttcatcgttctcgacgagttaaagcttgacgagatcaagaccaagaagttcgtagaggttatgaagaacttaaaggttgagaaggcacttgttgtattgaacgatatggatgtcaacgtaatcaaatccgcagacaacgttccgactgtaaagactgctcagacaaatgagctgaacgtatttgacgttctgaagtatgatacggttgttgtaacaaaggacgctgtaaagacgatcgaggaggtgtatgcataatggcaaacgtacagtattatgatgtaatcctcaaaccagtagtaacagagaagagcatggcagcaatggctgagaagaagtatacattcttagttcacccggaagcaaacaagtccatgatcaaggaagcagttgagaaaatgttcgagggaacaaaggttgcaagcgtcaacaccatgaacatggacggcaagaacaagagacgtggaatggtaaccggtaagactgccaagaccaagaaagctatcgtaacattaacagcagacagcaaggacatcgagatcttcgctggactgtaagatgaaaagcgtttcattctgatagcaaactaggcgcagcgatgcgcgataacaaacatcgaaaggagaacaacaatgggaattaagacatacaacccatatacaccttccagaagaaatatgactggctccgatttctccgagatcacaaagacaacaccggagaaagcgctcactacttctttaaagaagaacgctggtcgtaacaatcagggaaagatcaccgttagacatcacggcggtggaaacagaagaaaatacagagtcatcgacttcaagagaaacagcaaagacggaattccggcaaaggttgttggtattgagtacgatccgaacagaacagcaaacatcgctctgatctgctacgcagacggcgagaaggcatacatccttgctccggcaggactcacagatggcatgactgttatgagtggtgctgctgcagaggttcgtgttggtaactgcttaccgctcgagaatatcccggttggtacccaggtgcacaatgtagagcttcatcctggcaagggcggacagatggttcgttccgctggtatgagcgcacagctcatggcaaaggaaggaaagtacgcaacgttaagacttccgtccggcgagatgcgtatggttccgttaaactgccgcgcaaccatcggtgtgattggtaatggagatcacaaccttgtaaatatcggtaaagcaggacgtaagcgtcacatgggtgttcgcccgactgtacgtggttctgttatgaacccgaatgaccatccacatggaggtggtgagggccgtgctccgatcggacgtccgggcccatgcacaccttggggcaagcctgctcttggtcttaagaccagaaagaagaacaagtcttctaacaagatgatcgtaagaagaagagacggtaaggcgttgaaataagtttcaaccattgataagcccatcgggtgtttgtcaaaaatatacaaataagctggaatttgaccgggagaagttgtacttgcttcttccggcatgttctgctataataaacaagatgttcgtagtccgaggaaacacacgggtgtgtgtaaggactgataatattaggaggtaaattatggctcgttcattaaaaaaaggaccatttgcagatgaaagcttactgaaaaaagtagatgctatgagcaaagccggtgacaagtctgtaattaagacatggtcacgccgttctaccatcttcccacagttcgtaggtcacacaatcgctgttcatgacggaagaaagcatgtaccggtatatgtgacagaggatatggttggacataagcttggtgagttcgttgctacaagaacttacagaggacatggaaaagacgagaagaagtcaggcgttagataagaactatttttgaaaggaggtttcatccatggctaagggacatagaagtaagatcaagagagagagaaatgaagtaaaagataccagaccatccgcaaagttatcttatgcaagagtgtctgttcagaaagcatgcttcgtattagacgcaattcgtggaaaggacgctcagacagcattagctatcgtatcctacaatccgcgttacgcttccagcgtggttaagaaactgttagagtcagcaatcgcaaatgctgagaacaattatccggagaagaattacaagttggagaacctgtatgttgcagagtgttatgcaaacaagggaccaacaatgaagagaatcagaccaagagcacagggcagagcttacagaatcgagaagagaatgagccacattacaatcgtgctggatgagaaataataaggaggtcaaacatgggacagaaagttaatccacatggcttaagagtcggcgttatcaaagattgggactctaaatggtatgcggaagcagatttcgcagatttcttagtggaagactacaatatcagaacttatcttaagaagaagttatacgcggcaggtgtttccaagatcgagatcgagagagcatctgatcgtgtaaaggttatcatctataccgcaaagccgggcgttgttatcggtaagggcggcgctgagatcgagaagatcaagggcgaggttcagaagttcacagacaagaagttggttgtagatattaaggaagtaaagagaccggaccgcgatgctcagttagtagctgagaacattgcattacagttagagaaccgtgtttctttccgtagagcaatgaagtcctgcatgggaagaaccatgaaggctggcgcaaagggtattaagacatcctgctccggacgtcttggcggtgctgatatggctcgtacagagttctactctgagggtacgattccgcttcagacacttcgcgcagatattgattatggattcgctgaggcagacactacttatggtaaggtcggcgttaaggtatggatctacaagggcgaggtacttccggtaagagcgaataaggaagggggagctaactaatgttaatgccaaagagagtaaagcatagaaagcagttccgtggttccatgacaggaaaggcaaccagaggaaacacaatcacctacggtgagtacggtattgttgctctggaaccatgttggatcaaagcaaaccagatcgaggcagcccgtatcgctatgacaagatacatcaagcgtggtggtaaagtctggatcaagattttcccggagaagcctgtaacgcagaagcctatgggtgttcgtatgggtaaaggaaaaggctccctggagtattgggtagctgttgtgaaaccaggtcgtgtattatttgaaatctccggtgttccggaagacgttgcgaaagaagcgttacgtcttgctacacacaaattaccttgcaaatgtaaagtagtttctcgtgcggatttagaaggcggtgtatcaaatgaaaactagtaaatatttagaagaattaaaaacccagtctgtcgcagatttgagcgcgcagttagtagaggctaaaaaagaacttttcaatttgagattccagaacgcaaccaatcagttagataatacaagcagaatcaaagaagtaagaaagaacattgcaagaattcagacgatcattactgagaaagaaaaagttgcgcagtaggattccagaaaggagaatagtcagtcgtggaagaaagaaatcttagaaaaacacgtgttggtattgttgtaagcgacaagatggataagacaattactgttgcaatccaggataacgtaagacatcctctttacaacaagatcgttaagaaaacatataaattaaaggctcatgacgagaataacgagtgcaagatcggtgacaaagtcagagtaatggaaacaagacctttatccaaggataagagatggagacttgtagaaatcatggaaagagcaaaatagttagaaggaggctacaagcatggtacagcaggaaagtagacttaaggtagccgataacacaggagcaaaagagctgctcgttatccgtgttatgggtggatctactagaagatatgcgaatattggtgacgttattgttgctacggtcaaagatgcaacaccaggcggtgttgttaaaaagggcgacgttgtgaaggctgtagttgttcgttccgtaaagggcgcacgtcgtaaagatggttcttacatcaaatttgatgagaacgcagcagtcatcatcaaagatgataaaactccgagaggaacacgtatttttggaccagtagctagagagcttcgtgagaaacagttcatgaaaattgtttccttagctccggaagtattgtaggaggatcggaatatggcaaccatgaaaattaaaaaaggcgatatggtcaaagtaatcgctggtaaagatatcaacagcgaaggcaaagtcattgctgttaacagaaaagacggaactgtattggttgaaggcgtcaacatggtgacaaagcatacaaagccaagtatgcagaatcagcagggcggcatcgttcaccaggagggaccgatcgatatttctaatgtaatgtatcttcacaacggaaagcctacccgtgttggtttcaagatggatggagacaagaaggtacgtttcgcaaaatctacaggcgaagtaatcgactaattagagagaggaggccaatcaggtgagcagactgaaagaacagtaccagaatgagatcgtagatgctatgatcaagaaattcggttataagaatattatggaagtgccgaagctcgacaagatcgttgtcaacatgggcgttggcgaagccaaagagaacgcaaagttattagaggctgctattaaggatatggaagcaatcacaggacagaaagcggttgcaaccaaggcaaagaattctattgcaaacttcaagatcagagaaggtatggcaatcggatgtaagacaactttacgtggcgagaagatgtatgagttcatggatcgtttgatcaacttagcattacctcgtgtacgtgactttagaggtgttaacccgaacgcgtttgacggtcgtggaaactatgcccttggtatcaaagagcagttaatcttcccggagatcgagtacgataaggttgacaaggtacgtggtatggacatcatcttcgtaaccactgccaagacagacgaggaagctcgcgaattattgacacagttcaatatgccattcgccaaataagtaggagggaattttaatggctaagacaagtatgaaagtaaaacagcagcgtaaaccaaagttctctaccagagcttacacacgttgcaaaatttgtggtcgtccacattctgttttaagaaaatacggaatctgcagagtatgtttccgtgagttagcatacaagggccagataccaggtgttaagaaagcaagctggtaaaagaccgtgcagcatatttgctgcaatcaataataaggaggaaatatacaatcatgactacgagtgatccaatcgcagatatgcttacaagaatccgtaatgcaaacactgctaaacatgatacagttgacgttcctgcatctaagatgaaaattgctatcgctgacattcttgtagatgagggatatatcgcaaaatatgatattgttgaagatggtaacttcaagaccatgcgcattactttaaagtacggcgcagacaagaacgagaagattatcacaggattaaagagaatctccaagccgggacttcgtgtatacgctggcaaggatgagctcccgagagttcttggcggactgggaatcgcaattctttccacaaaccagggaatcatcactgacaaggaagcaagaaagcttcaggttggtggcgaagtattagctttcgtatggtagattttgcccgccattggacggacaaaatcggaagaaccaaaggctggttcttccgagagcatcttccgggagcatctgtctctggtctgtccagaagcaatgttgctttcggttcttccgggttacttaacctggaggaggttcttaccgaatcgggtaactacggcgcaagccgcaatgatataagcacaaattaggaggtacgggcatgtcacgtataggaagaatgccaatcgcagttccggctggtgtaacagtggatattgcagaaaataatcatgtgactgtaaaaggtcctaagggaactcttgagagaacccttccgtccgagatggacatcaaattagagggtgacgaagtaatcgttacaagaccgaacgatttgaagaaaatgaaatccttacatggattgacaagaacactgatccacaacatggttgttggtgtaactgatggatatacaaaggagctcgaggtaaacggtgttggttacagagcttccaagtctggaaaagtccttactttaaaccttggatactcacatccggttgagatgaccgatccggagggacttgagtccaaagttgatggaaacaagatcattgtatcaggtatcgataaagagaaggtcggccagtacgcagcggaaatcagagataagagaagacctgaaccgtataagggcaagggtatcaagtatgctgatgaagttatcagacgtaaagttggtaagactggtaagaaataattaaaggagtgacgaaaaatggttagtaagaaatcaagaacagcagttcgcgaaaataagcatagaagaatgcgtcatcatctcgtaggcactgcagagagaccacgcctggctgtgttcagaagtaataatcatatgtacgctcagattattgatgatacagtcggaaatacacttgtttctgcttctactcttgagaaggacgtaaaggcagagttagagaagacgaataacgttgaagcagcagcaaagcttggtaccgttatcgctaagaaagcattagacaagggtatcaacacggttgtattcgatcgcggcggtttcatatatcagggaaaagtgaaagctttagccgatgcagcaagagaagctggattagaattttaataggaggaaacgcaaaacatgaaacgtgaaattattgatgctagtcagttagagttagaagaaaaagtagtgtcaatcaaacgtgtaacaaaggttgttaaaggtggacgtaacttccgttttacagctttagttgttgtcggcgacggcaatggccatgttggtgcaggtttgggtaaagcagccgagatcccggaggcaatccgcaagggcaaagaggatgctatgaagaagctcatcacagtaaagctggatgaggttgacagtatcacacatgatgttattggtaagcacaccggtgcttccgtattattaaagaagtctccggatggtactggtatcatcgctggtggtcctgcacgtaacgtatgtgagcttgcaggtatcaagaacatccgtacaaagtctttaggttcaaacaataagcagaacgttgttcttgcaacgttaaacgctttgagccagttaaagtctccggaagaagtagcgaagcttcgcggtaaatccgtagaagagatcgtaggttaaggaggaatttaagatggcagagaagaaacttaaagttacacttattaaatccacgatcggtgcagttccgaagaacaagaagactatcgaagcactgggactcagcaagctttacaagactgttgagcttccggacaacgctgcaacagcaggcgcgcttcgcaaggttgcaccatatgtgaaagtagaagaagtttaaaataagaggataaggaggtgtcggtaatggacttatcaaatttacagggagcggcaggttccactcagagtgataatttcagaagaggacgcggacacggatcaggaaatggtaagactgctggtaagggacataagggacagaaggctcgttccggagcaccaagaccaggtttcgaaggtggtcagatgccattatacagaagattgcctaagagaggtttcaagtgcagaaactccaagacaatcatcggaattaacctttcagctcttgaggcattcgaggacggcgcagttgtatctgttgagacattgatcgaggcaggcgttgttaagaatccaagagatggcgttaagatccttggtaatggcgaacttactaagaaactcaccgttcaggcaaatgcattcagcgcaagcgcaaaagaaaaaattgaggctcttggtggaaaagcagaggtgatctaatgctagagacactccgtaatgcatttaagattaaagatattcgcaaaaagattatttttacatttttgatgttaatcgtcatcagaatcggaagctgtcttccgattcctggtgttgacagtgatgtatttgcgaactggtttgcaagccagaccgcagatggaatgggattctttgatgcaatcacgggaggttctttctacagaatgtctatctttgcattgaacattaccccgtacatcacgtcatccatcataatgcagcttcttacaatcgcgattccaaagttggaagaaatgcagcgtgacggagaggaaggtcgtaaaaagatcgcagagatcaccagatatctgacggttgctttagcgctcatcgaggcggttgcaatgacaatcggcttcagaagaggcggttatctggaattcagcagtggataccagggtgttcttgatattatcatggttatcttcacattgacggcgggatctgctgttcttatgtggattggtgagagaatcacggagaagggcgttggaaacggtatttccatcgtacttactatcaacattatctcccgtatgccggatgatattaagacgctgtatgatcagtttatttcaggtaagaatgtaccgaaagcaattcttgcggctgttatcattcttgcaatcattgttggaatggtactgtttgttgtatacttacagggcggcgagagaagaattccggtacagtattccaagaagatccagggaagaaagcaggttggcggtcagtcaacatacattcctctcaaggtaaacaccggtggtgttatcccggttatctttgcacagtcactgttgcagacgccggtaatcattgccagtcttcttggcaaaggaaatggaacaggtattgggagcaagatcttaagaggtatgtcacagtcaaattggtgtaatccaagcgagccgatttattcgatcggactggttgtatacatcgtattgatcattgcgtttgcatatttctatacatcgattacgtttaatccgttggagattgcaaacaacatgaaaaaagcaggcggatttattccgggtattcgtccgggtaagccgaccagtgattacctgaaccgaatcctgaattatattgtctttataggtgcggttgcactcgcgttcatcgcgtttgttccgattttctttaacggtgtgtttggtgcggatgtatctttcggtggaacgtccatcatcattatcgtaggtgtcgttatcgagaccttaaagcagatcgaatcgcagatgcgtgtacgttattataaaggatttttaaatgattgatccagcagagctgttggatatgggaaggaacgctggacttattttataagttcagcgttttcgcttaaaaagaaagaggagaggtattcctatgaaaattattatgttaggggctccgggagccggtaagggaacacaggcaaagcagattgcagataagtacagcattccgcatatttccacaggcgatattttccgcgcaaacatcaagaacggcacagaactgggacagaaagcgaaaaagtacatggatcagggccttctggtgccggatgagctgacctgtgatctggtgatggaccgcattcagcaggaggactgcaagaatggatttgtgctcgacggatttccaagaacgatcccgcaggcggaagctctggatgcagcgcttgttaagatcggccagaagatggacttcgcaatcgatgtagatgttccggatgagaacattgtgaaccgtatgagcggaagacgcgcatgcttaaactgtggcgcaacctaccacattgtttccattccgaccaaggtggagggaatctgtgaccgctgcggtaattcagtggtactcagagacgatgataagccggagaccgtacagaagcgtcttaaggtatatcatgagcagacacagccgctgatcgattattataagaagcagaacatcttaaagtccgtagacggtacacagccgatggaaaaagtgtttgcggatattgtggcaatattaggagagtaacatgtctgtaacgattaaatccccccaggaaatagaacttatgcgcgaggcggggaaaatacttgcaaaagtgcatgagcagctgggaaaagaattaaagccgggaatgtcaacactcgaggttgacagactgggagaagaaatgattcgaagctttggatgcgaaccgtcatttaaaggttatcagggttatcccgcatcaatctgcgtatcgatcaacgaggaggtcgtacacggaatcccgcgtgcagaccgcatcattgaggagggcgacatcgtaagccttgacgcgggtgtgatctacaaagggtatcagtccgatgcggcgagaacgcacggtgtcggtgagatctcggatgacgcgaagcttttgatagagagaaccagacagagctttttcgagggtattaagtttgcgacagcaggcaatcatctgcatcagatctctgcggcgatcggtgattatgccggaagttttggctatggagttgtgcgtgacctgtgtgggcacggcatcggcaagcatatgcatgaagatccggagatcccgaatttcagacagttccggcgcggtatcaagttaagacccggtatgacacttgccattgaaccgatggtagatctgggatctgccgaagtggtatggatggacgatgactggacagttgtcacagaagactggtcgctttctgcacactatgagaacacgattctgatcactgacggtgaaccggagatctttacgcttacagaatctgagattgcgacaggcagatggaatcagtatctgggcaggcagacagagtcatagaccggtcagtaagcgaatggagaaagagatagtatgattgaatttgcaaaatccatggcaggccatgacaggaaccatatttatctggttaccggaaaggatgagcggttcgtgtatctggcggacggcaatgtgaagctgcttgcggaaccgaagaaaaagaacagaaaacatattcagatcattcacagattaccggatgaggttctgggatgtctggaacaggaagttaccgatcttacggtaaagagggcaatcaaagcgtatgtgcgtattttgaaagagcgtgcagaatcataatattaggaggatttatttatgtcaaaggcagatgtgattgaagtagaaggaacagtggtagagaagttgccgaacgcattctttaaggtagagcttgagaatggccatcagattctggcgaccatcagcggaaagctgcggatgaattttattcgtattcttccgggtgataaagtaaccattgagatgtctccgtatgacctgacaaagggcagaattatctggagagataagtaaaaaaagaattgacttctaataagtgttcatgctataatgctaaacggacacttttggatagtgcctttttgcgcatgtagtgcgccaagaagagctatgatagaacatgagagatgcacgcgggtgcgtgccattcattgtttggaaaggaggatttgctgtgaaggtaagatcatcagttaagcctatttgcgagaaatgcaaagtcatcaagagaaaaggaagcatcagaattatctgtgagaatccgaaacacaagcagagacagggctaattgttcttgtctttttgcgctttcattatgtgcggctgcagtggaacaccaggatgagttgttcgcactgttatcatatgaaacagcagggatagctgcttttttgcgtttacataccgaggacgcaggggagaatcatccggaatacgagggaattgcgagggcacacatttcaggccggaggacaacggagctgccgcagcagattcttgaacgtaaaaagtcatgatgtcaagtggcttgcttaaagacgcggtctgtcatctggacagtcgcaggaatcagaaaataacaagatgcgcagtgtgtatcacaggcatcatatgaatcaatggaggttaaaaagcacatggctcgtatcgcaggtgtagatttaccaagagaaaaacgtgttgagatcggtctgacttatatctacggaatcggtagaacaagttctaaccgcatccttgcagaagcaaaagtagacccgaatacccgtgtcagagatctgacagatgatgaggttaagagaatcagtgcagttatcgacgagagtcagactgtagaaggtgatttaagaagagaaatcgccatgaacatcaagagacttcaggagatcggatgctatcgtggaatccgtcacagaaaaggtcttccggttcgtggtcagaagacaaagaccaatgcaagaaccagaaagggaccgaagcgtacggttgctaacaagaagaagtaattactttttcgattccgttcgtaggatcgccacgggtgaagtatggcggtcagttgcatacaatcattagattattttgagaaagtaggttagtttagatatggctaaagttacaaaaaaagtgacaaaaaagcgtgtaaagaaaaacgttgaacgcggacaggcacatattcagtcatctttcaacaacacgatcgtaacgatcacagatgctgaaggtaatgctttatcatgggcaagtgccggtggtcttggatttagaggttcaaggaaatctactccatatgctgcacagatggcagctgagactgctacaaaggcagctttagtacacggattaaagacagttgacgttatggttaaaggaccaggatcaggaagagaagcagcaattcgtgcgctttccgcttgcggtcttgaggttacaagcatcaaagatgtaactccggtacctcacaacggatgtcgtccaccaaaacgcagaagagtttaattaggagggagagacgaaaatggcagtaaataaagttcctgttctgaaaagatgtagatcccttggtttagagccaagctacttaggatatgataagaaatccaacagagagttaaagagagcgaacaagaaggtgtctgagtacggtcttcagttacgcgagaagcagaaagcaaagttcatctacggtgtattagagaagccgttccacaactactatgtgaaggctgatcagatgaagggcatgactggtaccaacttaatgaccatgttagagtccagattagacaacgttgtattccgtatgggattcgcaagaaccagaaaggaagcaagacagatcgtagatcacaagttcgtattagtaaacggcaagcaggtaaatattccttcttaccttgttaaggctggcgacgtaatcgagatcaaggagaagaacaagggtcttcagagaatgaaggacattgttgaggtgaccggcggaagactggttccggattggttagatgttgacgctgagaaattacagggaactgtaaaagaattaccttccagagagcagatcgacgtacctgttgacgagatgctcatcgtcgagttgtactccaagtaatcgtgattaggcggagacaatccaataggcaaattacccgagaaggagggattttgtagtgttcgattttcaaaaaccaaaaattgagatcgcagaaatttcagaagacaagaagtacggaaggtttgttgtagagccactggaaagaggctacggtacaacacttggtaattctttaagaagaatcatgctttcttcattaccgggtgcggctgtaagccaggtcaagattgatggtgtgctgcatgagttcagttcgattcctggcgtaaaggaagacgtaactgagatcatcatgaacatcaagaatcttgcaatccgtaataacagttctacgaatgagccgaaagttgcatacattgaatttgaaggcgaaggcgtagtcacagcagcggatatccaggtggattctgatattcagattttaaatccggatctggtaattgccaatttaaatggcggagcagattgtaagttatacatggaactcaccattacaaagggcagaggctatgtcagtgcagagaagaataagaccgaggatacaccgatcggtgtgatcgctgtcgattctatctatacaccggtagagcgtgtcaacctttctatcgagaatacgcgtgttggtcagattaccgattacgataagctgacactggacgtatacacgaacggtaccttggaaccggatgaggctgtcagccttgcggcaaaggtattgagcgagcatttaagcctgttcatcgatctgtctgaggctgcacagcaggcagacgttatgatcgagaaagaggataatgcgaaggagaaggttcttgagatgaacatcgatgaactggaactttccgttcgttcttataactgtctgaagagagccggaatcaataccgttgaggaattgacaaaccgcacaccggaggacatgatgaaagttcgtaacctgggacgtaagtccttggaggaagttcttgcaaagttaaaagagctcgggcttcagctgaatcagggagaagaataaatagaatcgagcaagctcgattcattagaagtttgacaggtcaaacttcgcgcttccgtctgaactgctaacgttcagacggtaccatgtatccgcgctaccgtctgggaagcgaatattcagaaggtatcatagtatatggcagaaacagtaagaccgaaaggcatggagtatgtcagcagccaaacgggaatgaatccacagggtttgttcctgcgcgaaatgtttcgcgcggcatcggatgagtaagaccaaaaggcatcatcggatgtaccacatcaatggaggaaaagaaaatggcaaagtatcgtaagttaagcagaacctctagccagagaaaggctttattaagaggtcaggtaacagcattattaaacaacggcaagatcgttacaaccgaggctaaggcgaaggaagtccgcaagatcgctgagggactgatcgctatggcagtaagagagaaggataacttcgaagaggttactgttaaggctaaagttgcccgcaaggacaaagacggcaagagagtaaaagaagtggtagacggtaagaaagtaaccgtatacgatgaagtagagaagaccatcaagaaagataagccttcccgtcttcacgctcgtagagagatgttaaaggttctttactctgtaacagaagttccgacagatgctgctggtaagaagaagaacaccaaggaagtagaccttgttgcaaagttattcgacgagatcgctccgaagtatgcagaccgcaatggtggttacacaagaatcgtcaagatcggtcagcgtaagggtgatggcgctctggaagtactgcttgagttagtataatcagatcgattttataaaaagagaagaaaccgctcagatgatgtctgggcggttttttattttataggaaataccgtgatacattcatgtgtgaaagtggaactttcctatgaaataaaaaacgctccgcgaggatgcgcagctcgcggtaaggaaaacatcgctttgcgaaccgctcgcgcgcggagaatctcacaagcgagattcttttttatgtagaaaataggagagcacggctttctgactgtgtaatccggtgatttcatccgatatatatataaggaataggatcgtaaaattacaatgaaggaaaaggagatttttctgtatggacagagacgacaacagaaaaatggatgaaggattgcagggaaatgagaagatcgaacaggcaatcagagaactccagcaggcaccgtctggtgaggaactggcgcatacacttacggtagtgcgcagacgcatgaaagaaggcgggcagtttattgtggcggtggaaccgccgcggggagatggaaaaattcagattcaggcaattcagacggcagatgggcagcaatggtgggcggcatttacaagcttcgaggaagaattaaaggggagtgggagcgtaatgtccacattcctttcggatatggaaaagttattcacagctgcattggggacagaagggataaacggtgttatcgtaaatccctggaaccgcacattgatgatggacaagaatctgatccagattgtgttgggaaatcaacattcctgactgtaagacccggcatttaggtccgatatatagagaaagacgttcagaagaacagggggaatgagttatggcgtttgggattgcatttgaaaatgggatcagatacgacggcaggacgggcggagaagcgcataagcccagaacagaccgcatggaaaaagaatttaagctggagacggcaccttacagtggaatggcggagaatggcatgatttgctataagggggttgtgtttacctgtgataccgagaataaccggatctgtctgggagatacgaccgatctgaagaaatgtatcaatattccgctggcgggaggcggaagtctgctggtcaacagagataatctggacgagctttccagggcgatcggaatgttttcgccggaggatgtcaagcgcattatgcaggcaatcgcacaggatacaaaggtacagcagatgcaaaaggaactggacgatgaaaagaacagcattggtaatttggcagccggtgaataaagtctggtgttgaagagttcaagagagaggagcgcgtggatgaatggatatgtgatagggttggtaatactgattgtgctggtgcttgcagcttctgcagcagcctctgtgatctgggatatcgactataagagacaggtatccggaaagagacagtttcgcaagctggaggatggaaaacgcatatcgcatgatctgcgcgagagacagccggaagatccggagatcatttatctgggatcgaagatcaaaccggatctggaactgcggcagaaatagaaagcgttcgtttacattcctgctttttaataaaagcaaggaactctgggagcggaagaggctttgaaaaatagaagccctggatgtagtcaatgccaagctgctccattgcagtaagctgctcctgcgtctcgattccctcggagacaataccgagcttcatgtcctgaatcatatgcatggcagcgttcatgacaaaacggcctttctggctgctaaaatatgcctgggtcattacccggtcaaatttgacgatctgaacaggcatctcgacaatatagttcagattagactgaccggttccaaaatcatccaatgagaagctgacaccgtaggaaatcagcttttccatgttggtaagcagtgtctgcttcatctccatagttgcggattcagtgatttccagattgatattggaaggatcaatctgataacgttccatgatgcggatatagcgctcggcaagtttttcatcggaacactgtgcaacagagagattgacttcgatgtaatgaagcccatattgtgcaagctgttcgttgcggatggcatggcatactttttcaaatacgatctcaccgatctgatgaatgcgaccgctctcttcggcagcgcagatagaatcatatatcggcagcagatctccgtgggcatcgtacatgcgcaccagtgcttcggcgcaggtaaaagccttctgccttgtggaatagatgggctgaaaaaatacttctatccggttttgcgatatggcatcgtcgattttctggatcagatcattttcggcatacatgtgtgctgcgacagaggaatccacgggaataaaacgctgcacagtctgtttgatttttgtcctgcggcaatagcgcagcagagaaaagaagtcttcctggcagggtgttaaaagacagtcttccagaaaaagaattttcagattgctgcccgaggaagctgacaggtaggtgtccagcgcaaatttttggatggaagcagtatcggcatgattccacatggacgcgggggtcagcattacgatctcatcatctgcggtcttaaaaatgtatgcaccgtcagtagacagcagtttttttgccagatcctgcattgtctgctgtgagtcgtcccccgaaaaccggtgatcattgatgaatacaaaggcagtataagcagacctgtcataatagatctgatgaatgaattcataaaaagcagtctggttatacataccgcttgcgcggtcaagattgatttcaggattttcaaattgcaggtaaatgatgacaacgccaaggcagctgccaaatcccacaaccaggatttcaggatttaaaaactggatgatcgctgagagtatccatacgagcatccagagtaacattcctgtgcgtctgcgcacacggatctgtctgcaatatttcaggatgagggcaaaattcagcaggatcagtccgaccgcaccaagatacgtcatgagtgcagaagaaccataagtgtatacgatgtgtgtaacaggatcacagtatatggaaatcggaagaagatagatggaaagacagatgacggaggtgataagcaggataaggtgctctgttttccggaaggctttgttggagagcagaatatccacgccgatatacataacaccgcataaagcggtcagcaccagggtgataaggtaggttttgcacacaaatgttacaaagagtgcaggcagatgggaagcagattcaattgcgacaatggaaaggatgtccatcaggatgcataacaccgtgaccgcatagaaacgcaaaaaagcgcgccgcgaatacgtctgcaacgtgtgctgctgatggtagagcagatatagaatcactaataaaacaaatccacatgcctgtacttttatattcataactccattacctcattcgtatagaaacatctatgtaagtggctttctccctgaatttatggtatcatatatggaagcggatgggaacggaaaatctgtggacttgatagaaaatgacggaggttttctcagaatattatagatcaggaggaagcagatatggacatgtccctgcttcagacaaaaatgaagcctgcaacaccgctgccagaacttcagacagtggaagatatctatagatggatcgatgaaaatattgcatatggatggcaggataaagacggaggaacgcataccagcgaaatgaaagatttccggagattgtaccggacaatgtctgtgacggaaaccctgcggcagaagatcggaacctgcattgaacaggttgcacttatgcatgaactattggatgcaatcggcattccgaaccagatgtactgctgtcggatatttgagccggatgattacggaaatctggaggaagaggagcatatgcactgctttcttttgtatttccaaaatggaaaaacatatcacatggagcatccgaatgtagaacaaaagggaatttatgagtatccgacagaagaagccgcgctccggacaattacggaatattatgtgaagctacgcggtggaaaagagagtcctaccacctgtttttccggcgtgccggcaggggtatcattccgggagttcaacgcatttatcaaccatctggcataggaacggagcaatgctcggaaacacgcgctgtggcgtcaccagaaaaaggggtatgcatataatatgcataccccttttggtaaaataatggatggtgttttacttagccgaagtatctctttaagagtccctcgaaagccttgccgtgtctggcctcatctctggccatctcatgaacggtatcgtggattgcatcgaggttggcagccttagctctctttgcaagatcagtcttgccggcagtagcgccgttctctgcatcaactctcatctgcaggttcttcttcgtgctgtccgttaccacctcgccgagaagttctgcaaactttgcagcgtgctcagcctcttcgtaagcggccttctcatagtacattccgatctccgggtatccctcgcggtgtgcaacccgtgccattgcaagatacatacctacctcagagcactcgccctcgaagtttgctctcagatcagaaaggatatcttcgctgacgccctgtgcaacaccgactacatgctcggcagcccataccttctcgccttcctgaagcttgaacttctcggccggtgccttacagaccgggcagaactccggagctgcatctccctcataaacataaccgcatactgtgcatacatactttgccataattcattctccttttcttataaaaattttaattggaatcaataatagtaactgttactgattttaaactgcaaaaaaacttttgtcaatatcttttttgcaattttctgatcaggatgagcatttttcagatgccttgcaggaagggcaggcgccgtaaaaataggtaatatgcccttcaatctcaccgtcaaagtcctgaccggcaagaatgttgatatgatctaagccgctcaccgtaagatccatcacacagccgcaatggcggcagatgaaatgatagtgtggagtagggttgccgtcgaaacgatccggtccgattcccggggaaagcttctggatctcgccgatttccgcaagcagattcaggttgcggtagacggttccaaggctgatattcgggaactcccttcggatattcagatatacggtctcggcggtagggtgatcataccgggttacaagaaaattcttgatagactcccgctgtttactgtacttcagcatggatgcgatacatcctttccttaaaactagtaattgttactgatatcatcttacacgtacagaaagaatttgtcaagagaaaaataggaataattattattttttgaaaagattctatttatggaatgcgtgcatatatatgaagataaggatagaagcatcagggagtacccatggcgggaatgaagcggtttgttacatatatatatgcctatgaggaggaaaaaaagggaagcaatgtcggatttgcgagaattgagatccggggacaggatgcaagaattgagattcatctgcgcggcgtctatgcggcgtctgcggcatgcagagtgtatctgttccagcgggaagcggcaggcgggaaggaagcaacaggtgtgaccggagtactggtcggtgagatgaagctgacgaacggaagcggcgatggcgccgttgtcttaaaaggcggcagagtcggagcatctccttatggcattacagagatggagggattgttttttgtcatcggagaagagcggattctgatgagccggtggcgcgagggtgctccgtttaaggtggggctgtccggattccgggagtggcagccggatgagccgaaggagaaggcagcagagaaaggggcggcagcagaaactgcggcgcaaaaagaagtgcgggaagcagccgcggcgcaggcggaacagaacagccagacggcgacgcaagagatggcgcagagaaagcagggggagcagccccggtacagtcggaacagaacagccggatggcggcaaaagggatggcgcaggatgtgccgtccgggtccggaatggagacggcagcggcaggggaggagacggaggcgattcatgccaccgagcttcccatgcgcaatctgttcccggaatacgactggaatgccgtgtgggaggagctctgcagagaacacaaaccggcggctctgtttgaggagtgggatacgcagtgcatccagctggaattaaaggatctgcggagtctgccgaaaaaatactggtatctgggaaacaacagctttctgctacatggatttttcaattatcggtatctggtgcttggcaggacggcggaggaacggtggttccttggcgtgccgggagtatatcagagacaggagcgcgtgatggcggctattttcggtttcccggaattctttgccgccggcccggggggtgagcgcagggaaggcagggaaccggtcaaccattttggctgctgggtgcgttatattgaagagtaaggatttaaaagggcatagcggatgtggtcttcccattttccctgaatctgggtgcaggcgtattcggtgccctcacaagtgaagccgatgacttccaaaagccggagagagggagtattttccggcatcacgcgggcaaacacgcggtgcagggaaagatcggtaaaagcgatgtttaaaacctttgtcacggcttccctggcgtagccctgatgctggaatgcggcgtcgaacttgtagccgatctcgctgcagcagtacggcatgcgcagaatatcgtgcaggcagacggtaccgatgatgatccgcgggttggtttttaagaagacataaaaacggatcgatgcacatttccgtgcgagatcatactcacattttagaatggcctgctggtgcgccggagtcagaaaataggggggacgcgtcggctcatagcgttcaaagagctcacggttgcggcactggaaagccagaacctcgttcgtgtcatcaggggtcagtatttttaagatcaggcgatcggttgtatacatggtatggacaggaagactgccggtaatatagttgttgcagttcatacatactccctctgccgaaaatgttccatcgacaaaatgcatcaaatcggctaaaataagtctatactatagtatagcatttctggagaaactgtccatgacacaggaagaaaaatatatgaaagcggcgatccgcgaggcaaaaaaggcatacgcactcgaggaggtgccgatcggctgcgtgatcgtccagaatgacaggatcattgcgcggggttacaacagaagaaatacagagggaaatacgctggcgcacgcggagcttactgcgatcaaaaaggcgagcaaaaagaccggcgactggcggctggaagactgcacgatgtatgtcacgctagagccgtgccagatgtgtgcgggggccattgtgcagagccgcatgaaaaaggtcgtgatcggcagcatgaacccgaaggcagggtgcgccgggtcggtgctgaacctgcttcagatggcacagtttaatcatcaggtcgagatcgagaggggcgtgctggaggaggaatgttcgacgatgctctccggcttcttccgggaactgcgcgataagaaaaagagactgcgtgaaaacgtgtagaatgcttgacaatcgggcgtcagataggatatacttaagtctccgagcagccggggtggtagcggtaccctgtaccaacaatccgctatagttggggtgatgccgaacagaggatcaggtaagctgtaaagctgcccatcataagtggcgttgacgtctgggtcttacgcaacaggaatctgtgaaccgggtcaggtcaggaatggagcagccctaagcagaagctcttgtgtgccgtgagggtgcctgggctgagctaactgtggtggtaacgtttatggttttggattcgaagtgaggcgctcggattttgcgttttataagtgttttttataaagattctgacagataacttttgggaagagggagagataccatgtgggataaggcgagaaggatattgtaccgtggcggagagatcttagagcttctgatggcggcagccgtcgtggcagggattctggtggcaatgatcacgcttgtgccggaactggcacgctactgggaacaccggacgatagccggtgcgtttatggagtatctggatgccgtttttaacgttgtcatcggaatcgagtttttaaagatgctctgcaagccgagttcggcgaatatcattgaggtgctgattttcctgatcgcgcgtcacatgattgtgcagacgaccacgccgctcgaggatctgctctcggtggtcagtatcggtattctattctttttccggcgttttatgctgatgaccaaaccggacaaggaccagcatgtcccgaagctttttggcgtgataaaggcgtcacagagcagcgggacagcacaggcggagcacgtggatgcagagaaaaatgcagaaggaagcaaaggcgctggggaaaaatagcacattgattgacagatgcatgacggtgttgtatgctgggagttagagatgactaacaaaaagcacaacccgtcatgcatttattttcgtacaagcattgctttttgtaaaaagcgctatataataaaagcataacggtggcgcagcccgcatgaatacgggaagtaagcgcttacattaaacacattgtcaaaggagagagtatactatgttcggatttggtcagttgatcgatatcttgaagaaagatccaaagaaaattgtttttacagagggaaatgacccgcgtattttagaggcagcatccagattactggcaggtaccttcctgcacccgattctggttggtaacccggatgagatttttaaggctgctgaggagagcggattcaatattcgtggcgctgagatcattgatccggcaaactatgacagatttgacgagatggtagatctgttctgtgaactcagaaagagcaaaggtgtgacaccggagcaggcaaagggcattctgtcccaggcaaactacttcggaaccatgcttgtaaagatgggcgttgctgatgcacttcttggcggagcaacctactctaccgcagatacggtacgtcctgcattacagctgattaagacaaagccgggcaactccatcgtatcttcctgcttcattctggttcgtccgtctgcaaccggtgagaacgaggttcttgcaatgggtgactgtgccatcaacattcatccgactgaggatgagttggttgagatcgcaggcgagtctgcagagtgtgcgaagatcttcggtgtagatccgaaggttgcattcttaagctactctaccttaggctccggcaagggtgaggatgtagacaagatgcgcaatgcagcagcaaaggcaaaggcaaaatatccgtctcttccgatcgagggcgagttacaatttgatgcagcagtatccccgcgtgttgcacgtaccaagtgcccgggcaacgaagtggcaggacatgcaaacacctttattttcccggacatcaacgccggaaatatcggttacaagattgcacagcgtcttggtaatttcgaggcatatggtccgatcctgcttggcttaaatgcgccgatcaacgatctgtcccgcggatgcaacgcttccgaggtatattccatggcaatcatcacggctgcactggcataatccggacactgcacagaacaatagaatgacagtcatttgtggcatggcgtgacgctgtgccacatttttttgagggaaaaatggaagcattactttttaccagagaagatttgaaaaaactgattgtaccgctcattatcgagcaggcacttgctttgagcatcgggctgtttgacacgctgatggtctcctcgtgcggcgaagcagcggtgtcgggtgtgtcgttagtggacagcatcagcacgctgctgatccagatcctatcggcacttgcaaccggtggcgctgtggtgtgcagccagtatatcggcaagaagatgccggagagggcaaaactgtccgccggacagctgatgcttatcatgcttgtgtccgcagggacggtgatggtgctggttttgctgtcctaccgttttttgcttcgggcaattttcggacagattgatgcggacgtcatgcagaatgcggagatttattttatcatttccgccatatcctacccgtttctgggcgtctacaacgcgggagcggcgttgttccgggcaatcggaaacagcaaggtcagcatgtatacaagtctggtcatgaacgtgatcaatatcggtggtaacgcggtgctgatcttcgggcttaagatgggcgtgatgggcgcagcgcttgcaacgctcacggcgcggattgtatcggcgctggtcatggttgtgctgctctcaaggaaggacaacccgctgtgcattgcgacaccgggctgtatgaagccgcagagggatgtgatcggaaaaattttaaagatcggtattccgagcggtgtggaaaacggaatgttccagattggaaaacttctggtgtcgagtctgaccgcgacgtttggaacggcggcaatcgcggcgaatgcggttgcaaacagtgtggcgggatttgccaatattccggggattgcgatcggacttgcgatcgtgacggtcattggcagatgcataggagccggggaaaaagaacaggcgaaatactacagcaagcgtctgcttggtctggcttatgcgggaatggtgctggcggatctggcactgtttgcacttgtaaaaccaatcattgcctgctttgcgttatcggcggaagcggcacggattgccacacagcttctggtaagtttcgcggtctgcgcggcgctgatctggccgctcagttttacccttccgaatgtgctgcgcgccgcaggagatgcaaagtatacgatggaggtcagcgttttttccatgtgggttttccgcgtggcaagcagttacttttttgccggaacgatgggacttggcgtgctcggtgtatggatcggcatgtatgtggactgggcgttccgcacgctgcttttcgtgatccgctaccggcgtggcaggtggctggaaaagcgcgttgtatgacgccgcaagggaattgattcctaatattttcttattttttgataatacagtttcatttttgcgggaaatacggtagaatatcagagaaatacgttcagatgatgaggattttgaagaaatgtacaagaatatgggaaaagtaaaacgtacgctggaggaatatgtgattctgacggttgccacgctgattctggtggtgggcgtttatgtgttcaagttcccgaataatttttcgtttggcggagtcacgggtatcgcggttgtcctaagtgccgttatgccggcaactccgggaaatatcacatttatcatcaatatggtgctgctggtggtaggatttattttcctcgggaaaagctttggcatccgcaccgtgtatgtgagcgtgctgatgtctgtggggctaagccttgcggaagtgtggtttccgatggagcatccgctgacgacgcaaccggtactggaactgatgtatgcgattgtgctgccggcattcagtgcggcgatcatgttcaatatcggagcatccggaggcggtacggatattatcgccatgatccttaaaaagtatacgaagctgaacatcggaggcgcgctgtttctggtggatctggggattgtcatagcttcgtgttttgtgtttgatgcacagacgggactttgttcgctctgcggacttctggcgaagtcgctcgttgtggacaatgtcattgaaagtatcaacctgtgcaagtattttacgatcatctgcaatgatccggagccaatctgtgattttatcacgaatgagctgcaccgcagtgcaacgatctataaagccgagggggcatatgagcacaaccagaagacgatcattatcaccattatgaagcgctcccaggcggtagaactgcgtaattacatccgcatccaccagccgaccgcatttattgctatcacgaacagcagtgagatcatcggcaagggattccgcgggtttaattgatagtaaaaggagaaaggtttttatgaaaatttgggaagacgaaaggcagtgctatatccgtgctgccatggagaagaattcagaggcggagaacgaggcgctgaaggcacagctggatgcgatcgactggtctgtgttagagcagattgagcgcaaggagaccgtgaacgagcggggcgtattcgcaccgcttgaggcggttgagacggaagaaattgagcggcgcagggacgagttccgggaactcggcatcaaggcgatccgggaaggaaaagtcggagcggttcttctggcggggggacagggaacgcgtctcggactggacagaccgaagggaacactcaatatcgggattcaccgggagctgtttttgtttcagcagctcatccgtaacctgatggacgtgacggatgaagccggcgcgtatgttccgctttatatcatgacgagcaacatcaaccatgacgacacgcaggcattttttgaggagcacagttactttggttacccgaaggagtatgtgaaatttttcgtgcaggagatggaacctgcctgtgatcatcaggggcgcgtatatatggagtcccgtaccagggttgccatgtccccgaacggcaatggtggctggtttggttccatggtgaatgcagggctgctctccgacatccgttcccacgggattgagtggatcaatgtatttgctgtggacaactgcctgcagagaatcgcagacccgctgttcatcggtgcaacgattgcctacggctgtgagagcggcgcgaaggttgtcagaaaggcagcgccggatgagaaagtgggggtgctctgtaccgaggacggcaagccatcgatcgcggagtattatgagatgacacaggagatggcgaccgcgcggaaggcaaatggtgacctgctctatggatttggtgtgatcttaaactacgtcttttccgagaagcgtctggaggagatcgcggatgcacatatgccgatccatgtggtagagaagaagattccgtatatggacgaatccggcagcctggtgaagccggatgcaccgaacggatacaagtttgagacacttgtcctcgatatggtacacatgatggcggactgcgttccttacgaggtcgacagaaagcgggagtttgcgccgatcaagaatctgcacggcgtggattcgctcgacagcgcccgcgagcttatgcagggctgcggcatcgaattgtaacataaaacggacgggcttcccggcgggaagtccgtccgtttttggcgctgcagaagatttaataaatattttatggggatttaacggcgggttcatgaatgtctgatataataatacctgatgatggaaaacagacaatggaggtttttataaattggaggaacaggggaagcagcaggaaatagaaatcgaagaggtgaccgcacaggagaatgtgatcgcggtgcgggatctggtgccgatgcgtgcggcgatggatgacagcatggaacggatcgcagatatgaaggaccagttttcacagacgatcgatccgatcctgcgcatgtacaatgcggcgatgtgtgcaacgacggcaaggcttgagataatagaggacgagttcaagtaccggaagctgcgctgtccgatccaccatattgacacccgcctgaagtcggcgaagagtattctgggcaagctccagaagaaggatctggatctgacgctgtcggctgcctgcaacaacatctacgacatcgcgggaatccgtgttgtctgctcttatatcaaggacgtctatctgatccgcgaccgtctgatggcgcaggatgatgttatgattatgcagatcaaggattacatagagacgccgaaggagaacggttaccggagtcttcacatggtcatccgggtgccggtatattttatgaacaaaaagcagctggtgccggtggaactgcagatccgcacgctggcgatggatctgtgggcaagcctggagcatgacatcaaatataagtgtctgtatcagacggagacggagaatttctccgaggaactaaaggaatgcagccggctcatttacgaggcggaggagaaaatggagatcatgaaccgtacactggaagcataaggggaggcgcgggcgatgagagagaaacagaatccggtcgaaaaagaatgggcagcagttgtcaaggcagaggagcgctttctgcgccatgccatgccggcgcggacggcgggctggcaggagaagatcacgcgctatgtgccacagaagctggaggcgactctgcacaccgctttttacaaagcgtttgaactgatctttgacaagggaacgccggtgatagagaagacctgccagaaggagaaaaaggagcagaattataagatcaatgcttacgccgcagaggtgcgcgacacgagacatgccctgcgggcattcgggagagaggcgggtgccagccggaacctgaatctggcggtatcggcggtggaaggtgtcggcatgggatttttcggtctgggtctgccggatataccgctgttcctcggtgttttgttgaaaagtatctacgaggtcgcactcagctacggatacacgtatgacacgcaggaggagcagatcttcatattaaagctgatcgagacggcattgtcgcacggcgagcagcttgcccagaacaatatggagctgaatctgtggatgcgtgaggagcgtacgttttccgtttccagaaacgagcagatccggcgcacatcggatgcactggcgggagaactgctgtatctgaaattcgtgcagggactgccggtagtcggtatggtcggtggagtttccgatatggtttatcagaagcgcatcagcgattatgcagcagttaaatataaaagacgttttcttgagacaaagaggaagaccggggaagaaaagagacatccggcaggataagtttgcggatggcatgcagaaggggaagccgttattcggcttccccttctgcgacaatatcctcaagaacatgaatcaggtcatacatgttgttgagacagacattccgttccagaatcagatttttcagatcagcagacagggtatcaaaccggtcgcggatctcgggagatacataagatgccataagattacctcactttttcatacttcagaaaaagtatgagcatccggagagctttttatgtgtaaaaaatgccgtaaaggtggtatgatagtggagaaaaagtggaatggaataagagtatgaatgagaaaatttactgccggatcaggcgtgtgcgcgcggtatttctgacatttttcctgacggcagcagttgttttgacagacgcacagaacatccgggaaaaggaatacgaaaaaacagagatcatatactgtattggggacagtatcacatacggcagcggtctggaggatgaggaacggctgacgaagtcgtatccggcgcagctaggaatccggcttggcccgcgctacctcattttcaattacggcgtgagaggagcaaccctgcaggatctttcccgtaaaagctaccgcaacatggggtatctgaacgtgatagaggcgcagtccccggatgtggtgattattatgctgggaaccaacgattccaaacagaaatactgggatgcagagaggtatgaggaacagtatcttgcattgattgacgaacttcacaatctgccgggacatccgtatctgtatctgatggcaccgccggaagcatttcctgcggaggagggagagatcctatacgggattaacaatgatgtgatcggaggagagatccggaaccttgtgccggacatcgcggagcaatcgggctgcggaacgctggatctctacgcgctgacgcaggatcacccggaatatttcgtggatggaattcacccgaccgaggaaggatatgcgctgattgcgcagatggttgcggatcagatccgggcagaccggaatgcgggcgtgtggtgacgcggttaaaaaagggcttcaaaaattacaaaaaatatgatataatgaatccattcatctgaaacggagtatggcgtagtttggtagcgcgcacggctgggggccgtgaggtcgcaggttcaaatcctgttactccgattccttggcaggggcacggcaggcggagcgatccgtctggcggcttaagaaagagagagaccgtatattgcggtgtctcttttttatgtaataggaaacttcgttcctattacacaaaaacgttccgcggggatgtgcagctcgcggtgaggtacataatgctttgcataccgctggggcgcaagtgtgcggcaagcgcacactttgtttttaggaaaaaagaaaggcatagaaaaacccggcagaatcaatttatgattctgccgggttttgtgacagcggagacggcgggattcgaacccgcgtgccccggagggctaacgcatttcgagtgcgccccgttatgaccgcttcgatacgtctccgaatgaatggatcacagaggattctactgtgagacactcgattagtatatcatatctggtttattttgcaagatgctttcgcgaaaagtcttgaaataagttttttcgggagatactatttttatagcataacaggagggtaaggtatggaaaataagacacgggaagcaattcggtttgagggaagcgtgcagggcgttggattccgctaccggatgtcacagcttgcaagacactacgatgtgacgggatgggtcagaaatgagtacgatggaagcgtctcggcagaactgcaggggagacgggaggcgatcgacgagatcattgcgcgccttagggaggattcctatatttatctggacagagtgagccggcagaaactcgaattaaacgaagaggagcgggcattttccgtgcgctattaggcgctgcggcgcgctggtgctgtgaaacacagttgcaaaatggcgtcgaagagggtaatattctatatagaaaaactgcggtccggatgcggacccacagaccatgaacggatggtacgaaaagacggaaacaggaggagaagcagatgaagagaatcggtatgttgacgagtggcggagactgccaggcattgaatgctgccatgcgcggtgttgttaaaggactcagcgagaacgtggatgaattggaagtatatggttttttgaatggctataaaggtttgatttacggggactaccggctgctgacatccgcggatttctccggtattctgacgaaaggcggcacgattctcggatcatcgcgacagccgtttaagcagatgcgtgtgccggatgcaaacggactggacaaggtggaggcgatgaaggcgacctaccacaagctcaacctggactgtctggtgatcctcggaggaaacggaacacagaagacggcgaacctgcttcgggaagaggggttaaatattatccatctgccgaagacgatcgacaacgatatttacgggacggacgtcacattcggatttcagagtgccatcaatatcgccacagattgcattgactgtatccacacgacggcagcgtcccacaaccgcgtctttattgttgaggtcatggggcataaagtcggctggctgacgctttatgctggcgttgcggggggcgcggatattattctgcttccggaaataccgtacgacatcgagaaagtgattgccgcgatcaacaagcgcacgaaggcaggaaaaggatttaccatacttgcggttgccgagggagccatctccaaggaggatgcggcgctctccaagaaagagtacaaggaaaaagtggcaaagcggaaatatccgtctgtttcctacgagattgcagaccgtatattcaaggagaccggcgtcgaggtgcgcgtgactgtaccgggtcacacacagcgcggcggaagcccatgtccgtatgaccgtgtgctctgcacgagactcggttcggcggcggcaaaagcgatcatggacgagaactacggcaacatggttgccatggtcaatggcaagatcaaatatgtaccgctcggagacgtggcgggcaaattaaaaacggtcgatccgaacgaccagatgataaaagaagcaaagcggattggaatcagctttggagattaaggtgagggaaaagcatgtcatatcaggcattatatcgtaagttccgtccgcaggagtttgacgatgtaaaaggacaggatcatattgtaacaacgttaaagaatcagattaaagcagacagaatcggacatgcttatctattttgcggaaccagaggaacgggaaagacgacgattgccaagatttttgcgaaggcggtcaactgtgagcatccggtggacgggagtccgtgcggggaatgtccgacatgcagggcgattgcggcgggcaattccatgaacgtgattgagatcgatgcggcttccaacaacggcgtcgacaacatccgccagatccgcgaggaggtggagtaccgtccgaccgaaggaaaatacaaagtctacattatcgatgaggtgcatatgctttccataggagcgttcaatgcactgcttaagaccctggaggaaccgccggcgtatgtcatttttattctggcgaccaccgaggcgcacaagattccgatcacgattctatcacggtgccagcgctatgatttccgcagaatctcgatcgacacgatcactgcccgcctgcgggaactgatggatgcggagcaggtgacggtggaggacagggcgctgcgctatatcgccaaggcgggagacggctcgatgcgtgacgcgttaagccttctggatcagtgtatcgctttttacctgggacaggagctcacttacgacaaagtgctggatacgctcggagcagtcgacacagagattttcagccgcctgctcagacagatcctcgataaaaatatcacgggggcaatccagaccgtggagacgctcgtgatcgaaggacgggagttagggcagtttgtcacggatttcacatggtatctgcgcaatctgatgctggtgcaaagctcggacgatatggaggatgtgcttgacatctcttcggaaaatctggcgctcctgaaggaagaggcgtctatggtggacgccgatattctgatgcgctatatccgcattttctcggagcttggcggccagatcaaatatgccagccagaagcggattctgattgaaattgcgataattaagttatgtaaaccggaaatggaaaaagattacacgtccctggtggaccgcatcgacagcctggagaagaaactggaaaaaggtgttgtgatggcggcaccggggagtgccaggcagggcgtaggtggaagcgcgcagggggcacagggaggctcgctgcccaaggcagaactgcccaaggcgattccggaggatgtgaagcaggtgctgacaaactggggcggcatcttatcgcagcttaccggcgtgacaaagacgtatcttaagatggcgacccggtcgctcggaccgaacggggaattgatgctggtgttcgatgacaaaaacgcttacgagtacgtcgagcagaaccgttcggattgccaggacgcattaaaagcggcagcggcggatcggattggcaaagaggttgcgattctggtgaagttaaacgacacggggcatgccagtgacgaggtctatccggatctgggcgcgctcatccagatggacatcgaggaagaggatttttaaagctggacgaatcacacaatttatattatgatagatggaacagtcctaagagaaaagcaggaggaagcagacatggcaaaaagaggtggattcccgggcggtatgccgggtaatatgaataaccttatgaagcaggcgcagaaaatgcagcgccagatggaagaggcccagaaggagttagaggagaaggaagtgaccgcggcagcgggcggcggtgccgtggaagtgacggtatccggcaagcatgagataacgaaagtaaagctttccccggaggttgtggatccggatgacatcgagatgctggaggatctgatcatggcggcgacaaacgaggcctaccgtcagttagacgaattttcccagagttccatggcaaagattaccggcggcatgggcggacttggcggaatgccattctaatagaatttataactgcacctgtgtggcgatcgcgctgtacgggtgcagttttgttttatggcactgcagctttagcgggtaaataccgtctgctgataagcaaggcgatgagaagatcacgacttttgctttcaggcagaatgcatatggaaattctgttcaaaaaatgtggcatttctgcctgaaatcagtatgacgtgcttcttaacattgcttatcagcagacggcaatgtctatctgatgcggcagtgccatgaaacaagagcaacctgcgtgggggcacatggtgctcagagctttgccttgaatacctcgtcggcgggatagccgccggcgcacttctgcatgccgcgctggatgctgtcggcggaggtgccccagtccttgtccttgttgcggtagtcgtttttctcaacaaaccaggacacttctttttggagccggtcgagattgtcctgtatcatcgagaaggctttgggataaaactcttttttctcgtcatcggtcagcttgtcctcggctgcctcgatcaggtcgccgaagtgcggcaggcagaatcccctgcttttttcaaaaagtgcgcggaattcctcatttttcttatacaggtcgaaaaaagtatccagataacggccgtagatctgatggaaatggtcgcagacatagcagtcggtggtcttagcggcgatccatgcgccgagaggcgttttgggcgcattcccggatgagacatccgtgtgcttcatgcgtttgataaagctggatttgccgggcgtaaaatgtgccagctcatcgtcgagctcctggttcagcttttttaagtgtgtgcttaagatcagggcgttgccgagccggttgccgtagtcgtacatcatcttgaagtggtggcggcagaaaccggtggcgtctgttttggcacggatatcatcttccatataggcagagccgaggatgaaggagatggcatgctgctcggcctcgcgttccaggtagcagaaagggcattcgtcgtctgcgtggaaggcattcatcaaagggatggttgcaatcgtttctttcatggtaatctccgtttcttttcatacaatctgtgaataaattcagtatagcataccagaggaagaaaaatcaaaaccgccttgtaaaatgcggcgttatcaagtaatatatataaggctgcagggaaagcccggcagtgttgacaggaagtttgagggagagaatggaatactatagcagacagatcagcaagttaatacaggaattatccgccctgccgggaatcggcacgaagtctgcacagcgtctggcatttcatatcctgaatatgccaaaggagcaggtggaggagctttcttctgcgattttggacgcaaagcagaatgtgcggtattgcaaggaatgttttacgctgacagatgaggaaatctgtccgatctgcagcgacagttccaggaaccacaaggtcattatggtggtggagaacacgagggatctcgcggcatacgagaagacacagaagtatgacggagtatatcatgtgctgcacggcgcgatctcacccatgctcggaatcgggccgggggacatcaaactcaaagaactgatgcagcgcctgcaaaaggatgtggatgaggtcatcattgcgacgaattccagcctggagggggagacgacggcaatgtatatcagcaaactgatcaaaccgaccggtataaaagttacgcggattgcaagcggtgtgccggtgggcggcgatctggaatatattgatgaggtgacgcttctgcgcgcgcttgaggggcgcacggaactgtagtgaccgcatgagaaagggatgcgactgtccggcatctgggtcggacggatgacaatcagatataagaaaggaccatgacacgacatgacgaatctggaacttcaaaagacagcaaatgaaattcgcaaaagcattgtaactgcggtgcacagtgcaaaagcgggacacccgggcggatcactctcggcggcagatattttcacatatctgtactttgaggagctgaacattgatccaaagaatccgaagatggcggatcgtgaccggtttgtattgtccaagggacacacggcacccggactttacgctgcgcttgcagagcgtggatttttcccgaaggaggatctggtaacgctgcgtcacacaggatcatatctgcagggacatccggatatgaagcatattccgggcgtggatatgtcgagcggttctctgggacagggactctcggtggcagtgggaatggctgcagcaggaaagttcgacaagaaagactatcgtgtatatgcactttgcggtgacggagagatccaggagggacagatctgggaggctgccatgtgggcaggatttaagaaactggataatctggtggtgatcgtggataacaacaaccttcagattgacggttccattgacgcggtatgttctccgtacccgatcgacaagaagtttgaggcgttcaatttccatacgatcaacatcaacggaaatgattttgacgagatccgtgcggcttttgcggaggcgcgggcgaccaagggaatgccgacggcgattatcgcaaagacattaaagggaaaaggtgtttcattcatggagaatgccgttgactggcacggaaaagcaccgaatgatgatgaatataagatcgcaatggaagatctggaaaaggcaggtgcagcattatgtcagaattaggaaagaagattgcaaccagagagagttacggcaacgcgctggtagaacttggaaaagagcatgaagatctgatcgtgctggacgcggatctggcaggtgcgacaaagaccggcatttttaagaaggcatttccggagcgccactgggacatcggtattgcagaggcgaatatgacaggaatcgcggcaggtcttgcaacctgcggaaaagttccgtttatcagttcttttgcgatgtttgcggcgggcagaaattacgagcaggtgcgcaactcgatcggttacccgcacctcaatgtgaagatcggagcgacccatgcgggaatctccgtgggtgaggacggagcgacccatcagtgcctggaggatctggctttgatgcgcgcgatcccgggaatggtcgtgctcaatccggcggacgatgtggaggcgcgtgcggcagtgcatgcggcgtatgatcacgtgggaccggtgtacctgcgttttggacgactggcggttccggtatttaatgacgaggcgacctaccggtttgagatcggcaagggaattgtgttaaaagagggaaaagatgtctcggtatttgcaacaggattgtgtgtgaacgaggcgagagaggcggagaagcttctggcagcagacggtattgatgcggagattatcaacatccatacgatcaagccgctggatgaaaagctggtacttgcgtccgcagcgaagaccggaaaagtggtaacgatcgaggaacattccgtgatcggcggactgggaagtgccgtatgcgacatcctttctgagaagcagccgacgaaagtcatgaagatcggtatcaacgatgtgttcggagagtccggtccggctctggaactgattcaaaagtatggactggatgcacagagcatctacgagaaagtaaaggcgtttgtaaaacagaattagagaaaaacgcagataaggccgcggggattgtagcttccctgcggcttttgtaatgccgggaaagattttggcagaagagacggaaggctgtcgaaacattttttcggacaagcccataatatttcaaaatatgcagagggcttgtggtacgatttccccgagaaaaggttgtaaaatccatgtgcgtgtattgcgcggatgcgcagccggatgcggaaaggggaatcgtgtggcatgatagagattattcaccaggaacagacggaagagaaggtacagagggaactgccaagagaaatcaaacagatcgggtcgccggatgcaggggaacggatttatgtggaagataccgtgtaccgcagaatgcatccgcatggcggcgtggaagaaaaaacggcatatgtgctgctgggaaaatttgagaactgcatgggcagagagtgcacgtttgtggaagcggttattccgttgaatgaaatcctgtttgaccgggatattccggtctgggacgatcacacgtgggcgtacatatataagcagttaaagccggagcatgatccgttcgtgattgtaggatgggcgctggatatcaagggacagctccccaatatgacggcgcacctggaggcgctgcatcaacggaacttcggtggaaagcgccagattctttttctgatggacagcctggaatgtgaggaggcggtctacggcagccggaacgggcacctgtacagaagagatggattttacatttattaccagcacaggcaggtgccagaggagaacgacctctggaaaaaagaggaaaaggaattttaccgggaaatggatgtggaaggggaagagaagccaaaaccggcagtgccagtaagcgccggggagcgggaagtggcggcggacatggcgaaaatgccggaaaatgaggaaggtacaggggtgtaccgtggtctttaccgcaggagagtacagcaggatgccggtcggcaggaaaagcaggaaagacccgcgtatgcagccacagttctgctgggggcggttgtgtgtgtgcttggtgtgaccgcatatctgaatcatgaaaagatggtggatatggaacagacgcttgcgcagatgaagggaacccggtatgtgacagaagcgcagacggcggacacggagacggaagagacggagcggatgccgtctgtggcggtagagacggtgatggggaatgtcgaaaaacaggaactgtctgcggaagcggcgggaacgcaggaagattctgcggcgcagcaggcggagacggcgcaggaggcacagggggcacaggggacagcagagccagcggaaaatgcaacggcaaatgcagcagcaggaactgcagcgggatcggaaactgcgggggatacggcggcagccggtggacaggcatgcgcagacgcagcgggcacgtcggtggaggcgcagacgcagagcacgccatccacggacggggacccggcggcggtacagacccagggcacgacgacagctgccggaaactcatcggcggagaatgtgcaggcggcagcagtgcagaccgaggcgcagatgtatctgtcgcagggatattatgatgtgcagaagggagacagccttgtgggaatctgccggaaaatatatcagacaacggcaatgctggacaagctctgcgaggtcaacggcattgaggatgaaaatgccatctacgccggtcagcgtctgattctgccgaattaaaaaaatagtgaaacgggaatacacacatgctataatattcataatcagtgaaagcatagacaacataggaacgaggaagtatggcagaaaaaaacaaaagcggatttcatacggtaggggataccgatatggaggaatataaccgtaaaataaaggaacatcgcagaaaggtcctgcgccgcatcgtgattgtgacggcggtcattcttctggtgctgaccggtctgggactctacatggcgctccgccattatgagaactatgacattatgtcaaccgcggagcggtcggatacggatgcgacacattttacggaatttcagggaaatattttaaaatacagcaatgacggagcattttatctggatgccgcgaatgaactgatctggaaccagacgtatgagatgtcgtcgccgaagctggatacctgcggaaattatctgagcatctacgacaagggcgggacaaaaatttatattttaacaccgacaaagcttgtgggaagcattgagacaaccatgcagattcagcaggtatgcgtggcagagcaggggacggttgcggttctgatgaaaaaagacaaggcggcgtaccttgcgctgtatgacagagagggcaacagcctggcggaaggggagatccacggccagaacgggggatacccgatcgccattgcgctttccaatgatgcggtaaagctggcggtatccatgatcaatatcaatgaaggaagcgtcaagagcacaattgcgttttacaattatggcacggttggtcagaacgaaatcgatcactgtgtgggagtgaacaattacgatgatatggtcatcccggagatggagtttacctccaacgaccggatggttgcgttcggcgatacgaaagcagtgatctttgagggtgcgcagaagccgcaggcaatcgcggagatcccgatggatgagaagacaaaaagtattttttacaatgagcactatatcggaatcgtgaccggcaatgaggatgaggcggtgacaaatcatctggcggtgtatgatgaaaacggaaaactggtcatggaaaaggatttcggtctggactacagcagtatcgaatttttgaccaataatgagatctgtatccggaacgcaaatgtctgcgacatctatacggtgcacggtgtttataagttccaccatgagtttgaagaagaactttttgagattataccgggaaaattaaaattgaactacacgcttgtgctcaaagatacgacacagcggatcagattaaaataaggaggagattatgaactgggtattgatgcttgtcctcctggtgttggtgtgctgtgcaatctacggctacacaaaaggatttttaaggattgttttttcacttgtcgcatgggtgattgtgctggtgtttgtctcgtgggcaacgccgcatgtcagccagtggatacaggagaatacaactatttacgaaaaaatagaagctgcgtgtgaggaatctgtgcggcgtgcggcgcagggaaagatggaagaaggcgcagtggaacagtacggagaagccggggaactggggctggatcttccggaatctgtgatggcgcagatcgtttcgggggcttccggcgcagcggacactgtgcttgcggagaccggggtatatgcagggatcgcgcagagcctggcaggatttatcgtgcagggaattgcgtttgtgacggtgctgattctctcatggattctggtgcatgtgatttcggcgctgcttggaattgtatcgcatattccgatattaaaaggcgtgaaccgtttcacgggaatgttagcggggctgatggaggggcttctcatcgtctggattgcgttttacattgttgccctttgcagtacgggagagacggggagagtgattgtttcttatattaatcagagtgcgtttctgaaagaactgtatgaaaacaatattcttctgtctctgggaacgggttttgcacgctaaaaggcatgaattacaagggctgccgacagtgaggggaaaatccgtgaaaactttttaaaaaaactgtaaaaagagtgttgacaatctgagatgcagatggtagtatatacaagctgaccgcgagaacagcggacaggcaaagggcttctgaaaagaagcaaaagaaaataaaaaagttgttgacaaacggttggcggcgtggtatagtaaataagctgtcgccgagagatgacaacgatgaatgagattgaaaaatccgttcggaagttgcggagcaacttctaatgacagcgcgaagcgctggctgtacattgataactgaacagtgaataaaccttgaaagatcctaaatttcaagctgtcgatcaagagattgaaagacagacgaacgttcttataaagaacaacctaaaacagtaaattcagagtaacatctgaataagccagattattctggaaaaggaaacaaactataacatgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccggtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacaaagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctcctttctaaggaaatcaagtagagagtttgttcactgtttagttatcaatgagtatctgcctggatgagcggagacaacggtgcaaattcatttgcaagccggtgttgaagcgaagacagattggacgaatgactctagcaagatgaagcggagcggaatcgagcgagtcatgagtacaaaggagcagatacgaatgacaactttatatttctggtggcgatgcgcttaggggaaacacccgtccacatcccgaacacgatggttaagacctaagcggccgatgatactatactggcgacggtatgggaaagcaggtggctgccagattaaatagcaaacataagatgtttgcattagaagaaatcaaagatttcttcgcagatatcttattacatatagaacgggcatcaagagtcagacgacctggtgctaacctattccaacagggtagtgttgttctgataaaactggttttaccagtgattagagatttcaatacgttgaggtttctaatgactgataaacattcagtcagacagtaacaaaagcattgaaaaatgccgatgttgcggaaattgcgaagcaatttctaatgcgaacgaagttcgctattgtaccttgaaaacttcatacagaagattttgatgaaaaagattttttatcaagacatccgagaatatcgtaaacaaagtttacgaccaaaccaaacgaacgaaagttcaagatcgaagcaattcgatccgcgttattaaacgcaaagacccagtttctaacgctatagaaactgtaaacgaggtcaagcaaaaaagagcgcagggtggatgccttggcactaagagccgatgaaagacgtgataagctgcgaaaagctacggggaggagcaaatatcctttgatccgtagatgtctgaatggggaaacccacatgagcatacctcatgtatccatacgccaatccataacgtatggaggggaacccggtgaactgaaacatctaagtagccggaggaagagaaagaaacatcgatttccaaagtagcggcgagcgaaatggaaagaggccaaaccggaatgcgtgcattccggggttcggaccgcataattgattcattgatcctagcagaaaggttttgggaaagcctgccagagagggtgaaagccccgtaagcgaaaggaaagatgacatggcggaatccagagtacatcgagacacgagaaaccttgatggaatgagcggggaccaccccgtaagcctaaatactccttagtgaccgatagcgcatagtactgtgaaggaaaggtgaaaaggaccccgggaggggagtgaaagagaacctgaaaccctgtgtttacaagctgtggaagtgctttatatgcacaaccgcgtactttttgtagaacggtccggcgagttacgggtaccggcaaggttaagcacttaaggtgtggagccgaagggaaaccaagtctgaatagggcgtcaagtcagtatccgtagacccgaaaccgggtgatctacccatgtccaggttgaagttgccgtaaaaggcaatggaggaccgaacgcacatccgttgaaaagggtggcgatgaggtgtgggtaggggagaaattccaatcgaacccggagatagctggttctcctcgaaatagctttagggctagcctcattttagtcttatggaggtagagcactgaatttccgcgggggcgtcaaagcttaccaaagaatatcaaactccgaatgccatgtagatgatgaatgggagtcagactgcacgagataagttgggcagtcaaaagggaaagagcccagaccaccagctaaggtcccaaagtgtgtgttaagtggaaaaggatgtgggatttcaaagacaactaggatgttggctcagaagcagccacacattcaaagagtgcgtaacagctcactagtcgagaggtcctgcgccgaaaatgtccggggctaaaacacaacaccgaagctgtggaatcacgtaagtgattggtagaggagcattcttaagaccgacgaagctgtaccggaaggagcagtggagggataagaagagagaatgccggaatgagtagcgagagagaggtgagaatcctctcggccgaatatccaaggtttccagagtaaagctgatctgatctgggtaagtcggggcctaaggagaggtcgaaagacgtatccgatggacaacaggtttagattcctgtaccacatatgaacagaactgtggggacgcatgtggagagcacgagccgggaatggaaataccggtacaagcggagaaggagtctggttggcaaatccgccaggcaatccgaagacgtgatgtggagcgaattaaagtagcgaagcgtgtgagccatgtgccgagaaaagccgctattgtttcatgtgtgcccgtaccgtaaaccgacacaggtggatgaggagagaatcctaaggccggcggaagaagcattgttaaggaactcggcaaaatgaccccgtaacttcgggagaaggggtgcctgctaacgcaggccgcagagaataggctcaagcaactgtttagcaaaaacacaggtctatgcgaaaccgaaaggtgaagtatatgggctgacgcctgcccggtgctggaaggttaagaggagaggttagcgtaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttggtactgggattcggtactgcatgtacaggataggtgggagactaagaacttgggacgccagtttcaagggagtcgctgttgggataccacccttgcagtattggatttctaaccagccgccgtgatccggcggtgggacaatgccaggcggggagtttgactggggcggtcgcctccgaaagggtatcggaggcgctcaaaggttccctcagaatggttggaaaccatttgaagagtgcaaaggcagaagggagcttgactgcgacaccgacgggtggagcaggtaggaaactaggacttagtgatccggtggcataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgctgtcgaccaacggcatggcagagtagccaagtccggaagggataaacgctgaaggcatctaagcgtgaagcccccctcaagatgagatatccctcacataagtgagtaagatcccttgaagactacaaggtagatagggcagaggtggaagcacggtaacgtgtggagctgactgttactaatcgatcgagggcttgaccaaaaagtttgttggatgatttctgtatgaagttttgaaggtacaatttttatggcccaatggctcagttggttagagcgccgccctgtcacggcggaggtcgcgggttcgagtcccgcttgggtcgtttttatatgggatcttagctcagctgggagagcatctgccttacaagcagagggtcataggttcgagccctataggtcccatttcttattatatatgccgatgtggctcaattggcagagcagctgatttgtaatcagcaggttatcggttcgagtccgatcatcggcttttcacataatttcatattgtgtgtaaatgggcagattcccgagtggccaaaggggacagactgtaaatctgctgcaaattgcttcggtggttcgaatccacctctgcccattcttttgataacaaatattatcagaagtaatttcatagcgcgggatggagcagtctggaagctcgtcgggctcataacccgaaggtcataggttcaaatcctattcccgcaactcaatgcgaaagcatttgtgcccagttagctcagttggtagagcagaggactgaaaatcctcgtgtctctggttcgattccggaactgggcattgtgttttgtttaaaaataatatgggatactagctcagttggtagagcacctgacttttaatcaggttgtcgggggttcgaatcccccgtgtctcattaggaaatgaagagcggaaagccggtaaattcaaggcttcccgctctttttatgccattttcccagtagggaaaagtaagcaaaagttgatgatttttaatgtccgcagcgcgtccgcaaggggtattttgacaccaatgtccgcagtgcgtctgcaaattaaaccgccagaatatcattcacgaccgccgcggcatcttctttctcgtccatgatgtggttgtagacgtccagcaccatcttttcggtgtcacccatcagctgggcgatttttttaatgctgatcgcaggtacctgatagcagaggtttgagcagtagttgtgccggaagatatgggcggtcagatcagatatgactgggaacgcaccggtaccaccggcggcatggttcatttttctcacgatcaactgccacatcttgacatacgctgaatgtgtcatgatggacccatcacggcaggtaaaaaggtatgagccgggcagagcagccaaatactcttttaggtatgcggcggtggctgccatgtcgattgtgaaccggatctgcatgttcgtcttctcggtcggacttggaatcggtcagggattccagccggtgtcggcattcaactatggcgcaaaaaaatacggaagggtccggaagggcttctatttcacactcacagcgggagaagtgctgctcggcgcgattgcggtcatcgggatgtttttcccggcacagcttgtggcggtatttcagaaagatcccgaggtggtggcgatcggagagggggcgctccgggtccagcttgtggcgctgttctttcagccgatgacggtctgcgcgaacatgatgtttcagagcatctggaaaaacggcagggcgatgttgcttgccatgttgcggaatcttatgtattatagtgaaaaaaggttgacagtcccggcataaagctgtatcatacttaagtggattcacactgcaacgcgttgcagtgtgaaaatataagaagataccatatgcagcagtgcgtatgacagaaaggatcaatagatatggaaatggagatggaatttttgcggaagctgcctactccgcaggagttaaaggagcagcatccggtcagtgcacagattgtagctaccaagacgaagagggatgacgagatcaggaatatttttgaaggaaaatcggacaagctgattcttgtgattggcccatgctcagcagataatgaggatgctgtgatcgactatatttcaagactccgcacggtgcaggagaaggtggcggataagatttttatgattccgcgcatttataccaacaagccgcgcacgaccggaatcggttacaagggcatgctgcatcagccggatccggagcgggaatcagatatgctaaaagggatcattgcgattcgtcacatgcatatgcgggcggtggaagagaccggctttacctgtgcggacgagatgctctacccggagaatcaccgctatctttcggatctgctgtcgtatgtggcgattggagcacgctcggtagagaaccagcagcacagactgacggcaagcggcgtgggaattccggcaggaatgaagaatccgaccggcggagatatttccgttatgatgaactcgatcattgcggcacagcacggacatacgtttttataccgtggctgggaggtcaagacgaccggcaatccgtatgcacatgccattttgcgcggatatgtggacaagtttggcagaaatattccgaattatcattatgaggatctgcagaatctgctggagcattatgaagaggcgaaggaagccggacacgagctggcacatccggcggtcatcatagacacgaaccactccaattccagcaagcagtttatggagcagatccgcatcagcaaggatgtcctgcacagctgtaaggtgtcaggagagataagaaagctggtgaagggactgatgatcgagagttatatagaagacggagcacagaaggtcggtgacggctgttacggaaagtcgatcacggatccgtgcctgggctgggagaagaccgagaagctgatctacgaattggcggaactgtggtaaaggagagagaatgtaccggatattgatcgtggaggacgatgagatcattgcgcgaagcttaaaaaagcatctggaaagctgggattatgatgtggtctgcgtggaggatttttccgatattatgaaggagttcgcgggggcggcgccccagctggtgctgatggacatcaagcttcccttttacaacgggtaccactggtgcagcaggatcagggagatgtcgaaggttccggtaatcttcgtgtcgtcggcgtcggataatatgaatatcgtcatggcggtcaatatgggcggcgatgatttcattgccaagccgttcgatctggatgtgctgaccgcgaagattcaggcgcttctgcgccgcacctatgattttgccgggcagaatacggtgctggagcatagaggcgcactcttaaatctgggcgatgcgacactcacctgcggggagacgcgggtggacttaacgaaaaacgaacttaagatactgcaggtgctgatggagaacaaggagaagatcgtgtcccgcgatacgttgatgacgaagctgtgggaaagcgacagctttgtggatgagaacaccctttccgtcaacgtgggaagactgcggaaaaagctggatgcagcaggacttccggattttattttgacgaagaaaggaatcgggtaccatatcgggtaggggattttgatgaagcagaaaataggaagatcctacataaaatgccgtctgaaatggattgccgcagtgactggctgcgggatcgtgatgacggcagtcttatttttaaatgaagtgcctgccggggagattgcctacggcatgctgttgtgtctgggaattctgctgcttgcagtgacgatggataggataagttacggcagacggcacagggaactgctggcattgcggcagtcaataacggtatcgctggagaatcttccggaacccggcgaaatcctggaggaggattatcaacggctgcttgggcttttggcggaggagaaaatgcgtatctggaatacggcagtcagcgaaaagcgcgatctgatggaatactataccatgtgggtgcaccagatcaagacgccgattgcggcgctaaagcttttaatcgaggaggaagcggatattcccggtgcagaggagcctttgggagcggacagggaaaggctgcagcggcagagggagaagcgcaaggatgaagaactacagcagctgtttgcgattgagcagtatgtgaacatggcgctttcgtatatgcgtctcggatcggagaccacggactttgtgctgcggcagacagatctcgacgaagtgatccggatggcggtgcgccgctatgcgagacatttcatcagcaagaagatcgtactgcactacgaggagacgggggcacgggtgctcaccgatgaaaaatggctcggctttgtcatcgaacagctgttgtcgaatgcgctcaagtacacgcatgaggggagcattacgattgggatggaggagggacgccttaccattaccgatacggggatcggaatacgcgcggaggatctgccgagagtctgcgaaaaaggctataccggatataacggtcatgccaaccagaaatcgaccggaatcgggctgtatctttgcagcacaattttaaaaaagctggggcacagctttacgatcacatcgcaggaaggaacgggaacccgggtgatgatcggcttcccggaagagtcatagaagaatcttacaaaaacgtaagaaacagcagagaaatgtaatccaaagaaatggcttgcatttctctgttttgttatactgggtacagtcaaggaaaggagagagacacatggctattctggaagttcataatttgaaaaaaatatatacaacaaggtttgggggaaatcaggtgcaggcgcttgcagatctgaatttttccgtggaaaaaggggagtatgtcgcaattatgggagagtccggttcagaaaagacgacactgcttaatattctggcggcgttagacaaaccgaccgcgggggaagtgctgttgaataataagaacattgtgacactcggcgagagggagatttccaaattcagaagggagaacctgggctttgtttttcaagattttaatttgctggatcatttttcattaaaagataacattcttctgccacttgtcctggcagatgcaccggtgcaggagatggaggagcggctttggccgattgccgaaaagcttgggatcgatgtgctgcttgagaaatatccttatgaggtttccggcggacagaagcagagggcggcggttgcccgcgcactgatcacccgtccgcagctgattctggcagatgaaccgacgggggcgctggattccagggcgaccgacggactgttgaagctgtttggcacgatcaacggggaaggacagacgattcttatggtgacacattccacgaaagcggcgagccatgccaaccggattctttttatcaaggacggcgaagtatttcatcagctgtaccgcgggaatatgacgaatgaggagctgtatgtgcggatttcggatacgctgacggttcttaccaccggcaaagagggaggctgtcatgcgtaagttatatgtcaaactggcagcagtcaatatccgcaataacagacagctttacctgccgtaccttctggcgggggtgttctcggcagcgatgttctatctggtaatgtccattcaggataacccggggctggagcagatgagaggcggcgcctatgtggcggtaacgctgctgctcggagtgatcattgtcggactgttcgcggcgattttcctgttttataccaacagcttcatcatgaagcggcgcaagcgggaattgagcgtatacaatatacttgggatggagaagaaacatatcgccagggtgctttttctggaaatgctgtttacggcggcggttacgatcggcggaggcctgttgttcggcattgcattcggcaagctgatgacgatgcttttgtaccgcatgacaggattcaaccagagcgttccgtttaccatttcgctgacgggatgccgccacacgctggtgcttttcggctgtatatacgcggtcacacttttctataactttatgcagataaagctttccaatccgatggaactgctgcacagcgccaatgcgggagagcgggagccgaagacgaaagtgctgctggcggtgatcggagcggcggcactcggcggcggctattatctggcgcttacggtggcggacgcagtctctgccattaccatgttttttgtggcggtgctgcttgtgattctgggaacgtattgtctgtttactgcgggcagtattgccgtactcaaactgtttcggaaaaataaaaactattattacaaatcaagacattttacgacggtttccggtatgatctaccggatgaaacagaacgcggtgggacttgccaatatctgtattctgtcgacgatggttctggtgacggtttctaccaccctgtgtatgtatctgggagtggaagacgccctaaaacggcgttttgcacatgaggtgtctgtggtgtcctactataatgcaatgccggaacatccggaggaagtggatgccctggcggaagcatccctgaaggattccggacgggtactgacggggcacagcgccatgttgaacatgtcgctgaccgcggtgcgcacggacgatggattttccgtgaccggcatcggggcaggcacagattacagtattagtgatgtggtgctgctcacgattctgccaaaatccgattgggagaattacaccggtgaaacggtcggggaacttggctgcggagagattgcactggcagcatcctctgcctatgaaaaagggacgttggcgcttgacaacgagacatatcaggtaaaacagatctacgcatatcctgagacggatcacgattatctggatgacatggcagacgacagtgtatttatgattgtgccggatagggaggcgctggggcagatttttacggagttgaaacagaactgggacgaggagcgtgtaagcctgcagatcaaatacaatatggcgtttgacatagacggaacagcagaagaaaaagtggcagcggaaaatacgcttcatgcggcgattaccgcatacaatgacgggcatccgtcggatgatgcaaaggactcttattctagaacgtatgtcgaatgccgggcacagaaccgggatgaatactacagcttaaacggtggtctgctttttatcggtctgtttctgggcgcgatgttcctcatggtgacggtgctgatcattttttacaagcagatctcggaaggctacgaggacaaggaacggtatgccatcatggagaaggtcggcatgagcaatgccgaggtaaagcggagtatccgtacacagatcctgacggtatttttcctgccgatcggggcagcagtacttcatgttgtcatggcattcccgatgatcaaatggattctggcggcgttcagcctcaacaataccgcactgtttgccttatgcgttgcggttacggcattggtgtttctgctgatttatctgctggtgtttgcgctgacttcccgcagctactataagattgtggggaatcaggtttagggaaaatggttcccaccataaaatccaaaaactcttccagtgtcattttagggttctgcagccagcgaatgacactggcgagaaggccggacaggtaaaaatcggcaagaagtgccatctcgtaatcgtcatgtccctccgagggaacaaaataacggtttaagaggggccataccacttctttcaggcgggtcgcaaaatgcgggtcgccatgatcgcttaagagtacagcagcataggtttcatatgtctgcatcagatctaaaagaattcccatctgaccggaaaggtcaaaggtatcatttttttccagagaatcattcagaacatctgtaattttcccgaggatttcttcctcaatctgatgaagaagatcatatacatcattatagtagagataaaaggtgccgcggttgtaaccggcaagctcggtaatctccttgatggagattttttctatcggtttttgcgcgtagagagaccagaaagcgatccgcagattatttttggtctgttctgtgatatggggctgctttttcatgaaaacctcccggtataagatttgtgttcattttgtcttcacgtaaattatagcacgacaacgtgttgtcttcaattttttaacacgtgcggagaatctgttgattgatgaaaggcagcgcggggagtacattaggcatagaaaatggaatctgcatagagataaaaaacagagtctgggaagaaaggcggccttttatggcatatatcgaatttaataatgtaacgaaggaatataagacaggtgagacttcgatcaaagcgctggatggagcctcattttctgtggagaagggcgaactggcagtgattctcggttcctccggtgcagggaagacgacggcgctcaatattttaggcggaatggatgtgccgactgcgggcgagatcaaggtggatggcagagatattgcaaagtataacaaaaagcagctcgtcggataccggcgtaccgatatcgggtttgtattccagttctacaatctggtgccgaatctcacagcgatagagaatgtggaacttgcggcgcaggtgtgcagaaattcgctcgatgccggggagatgctcacaaaagtgggactggcggaccgcaaaaataactttccggcgcagctttccggaggagaacagcagcgggtgtctatcgcgcgtgcgatcgccaagaatccgaaactcctgctctgcgatgagccgacgggagcgcttgactataacaccggaaaacagattctgcagctgctgcaggatacctgccggaacgatgggattacggtacttctgattacgcacaactctgcgctggcaccgatggctgaccgcctgatccgctttaagagcggaaaggtgacagagattacctgcaatgcgcaccctacgccgatcgcggagatcgagtggtagcggggcagaagagaaaggcagggatactgatgaagagtgcatataataaggagatatggcgggcgatccgcaaggggaaaaaacggtttttctccatcatgctgatcacgattctgggtgtcggaatgctcaccggattgcgggctgcctgcatggatctgcgctattcggcagatcagttttatgacagacagggactgtacgatatcagtgtcgtctcgacgctcggacttacggagaaggatgtggatgcgttaaaggcactggacggtgtcgcggatgcggtcggcgtctacagtgagacggtacatgcgaaagtaaacgatcatgaggtcagcattgcagtctgcacgttgaatgacaggggaatcaatcagccgtatgtgttgtccggcaggctgccggagagtgcggatgagaccgccgttacaaccgcgtttgccgatgagacgggatgcggcatcggggatgtcatcgcggtggatacaacagatgatgaggagtcttcgctgctctgcagccgctttaccgtaacgggaattgtggtggatgtgcaggatgtcaacaatgcaaagggagcgacggcgttccgctccgggcagtcggaggatgacactgtgttcatcttgccggaggcggcagacagcgatatttacacacaagtctgccttaccgtcgatggtgctgcagaattgttctgctattccgatgcctatgaggaaaaggtcgcacaggtgacggatgcgattgaaacgcagattaaggaaaatcgggagcaggcacggtacgtggaagtcacggatgaggcgaaagagaagcttgcggatgcgaaagcggaggcggaagagtcctttgctgaggcagagcagcagctttccgatgcgagagcagagctggataagggctggcaggaactttccgacggccaggaggaatttgatgcggaaaaacagcaggcggaggatggttttgcggaagcgagagatgaaattgccgcgggaaagcagcagattgccgatggcagcgcgcagctggatgcagcggagcagcagctttcggaaggcgaggcgcaggtggcatccggtaagcagacgctttcggcaaaggaagaggaaacctatgcacagttagacgcggcacgcgcacagcttacagagagcagtaaacaggcagcggagacggaggcggcattggaagcgcaggcgcaggaggtcatccaggcgtacggggaagcatggcccgctgaggcctgggacgcctatgtgcaggcggcagtggaggcgtatttacccgtagcaagagcggtggtcgcagagcaggatgcctcgcaggcacaggcggcggtgccgggactggtggcggacagccagagtgcgtttttggaggcgctgcagcaacccacagccgatcagctggtacagcttgcaatgggactgggaaatgtgcgggcgacaatccaggcgctcggcgaggcacaggcgcagctggatacggcagaacagacggcacggcagcagtttgatgcggcatggaacgaactgaacgaaggggaagcacagatcatcttcggaaaatcgcagattgccgataagagagcagagctggagaacggcagtatggcgctttccgaaggcgaggcgcagctggcgcaaaaggaacaggagactgcggcgcagataaaggacggtgaggaaaatctcgccgaaggacgggaaaagctgcttgaaggtgagacggaatacgcggacggcaaggcagaatatgaagaaaatcttgcggacttcaatgagacgattgcggaggaagagcaaaagattgcggacattgacatgacacagtggtatgtacaggatcgcacgtctctgagcggttatgccaatgtgaagagcgatgcggcgtcgattgaggcgatcggtacggtgttcccgatggtatttttcgttgttgccattctcatcagcctgacgacgataacccgtatggtggaggaggaccgcggtctgattggaacctacaaagcgctcggctttacggatcgtgagatccgcagaaaatatctggtgtatgcatgtgcggcgagtgtgtccggcggaattctgggaaatgtgtgcggatttgttcttctgccggagattattttccggatttttgatacgatgtatctgttcccggaatatctgctgcgctttatgccgctgctcggatgtggcggagctgcactttttgcggccggaattgtcatcgctaccgcctgtgcatgtaaagcggaacttgtacacatgccggcagttctgatgcggccgaaagcgccgcgcgcaggctcccgcgtactgctggagcgcatcacgccggtatggaagcgcctgtcatttctcaataaagtgaccgcccgcaacctgttccgctataaaaagcgtcttttcatgaccgtagcgggaattatgggatgcatggcgctcttacttttcggattcgcggtgagggattcggtgacagacctgctgccgcgccagtatgagaatgtgtaccggtatgatgtcatggcggcgggggcagcatccgacaatgacaagattctttcctatgtaaatggggatccgaatgtgcaaagtgcgctgaacgtgcagatttccacggtgaagctgaagaatgctgccgggaaggaagaaaaggcacagatgattgtcgtgccgggggatgagcctcttgcagagtacattggtctgtacaatcttaaggatgaggagatcggccttttggacggcgagattctggtgacgcagaatgcggcaaatgtgcttgggtttgcggccggcgatcaggtggagattcaggatcaggatctgaatcagcgggaagtgacggtaagcggtctcgtccgcaattacctcggcaataacgtctatatgacagagaaaacctatgaatcgctgtttggcgattatgaaccgaacggagtatttttaaagttgtcggaagaatgttcggatgaaattgcctatgcagatgatctcggcggaaaagagggtatcgtgtcctacaccagcaagcaggagctttcggatgagttctcggatgcgttcaccctgatcaatatggtggtctacattgtgattatcatggcggcggcgctcgcgttcgtggttttatttacgctgtctacgacgaatatttccgagcggagcagagagctggcgacgattaaggtgctgggattttttgaccgtgaagtgcatctgtatgtcaacaaagagaccatgatactcacggcgatcggcattgtctgcggaattccgctgggatatgcgtttgcgcagaccttaacgtatgttttgaacatgccgtcgatttatctggcggtgtcccttcacgggaaaagctatgccatggcggcaggcctctcatttttgtttgcgatcctggtggatctgctgacgaaccgctccctggatgaaattgatccggtggaagctttaaagagtgtagaatagaaaaagcgccggcaccgatgggtgaagttcatcggtgccggcgcttttgggatgtgttacatcctgtgttttatgatgcggatgtcagaatctgcatcgtttatcctgtgggtaattaacatccgaggttaaagtatttgcaaagagcagtaaataactcggaacagctattgaagttaaagcacatagtttcgtcctccttattcttatttgtgttagctaagcacaaaagaattgtaacaattatgtaacaattctgcaataggaggatattggaaataggattacgcttcaagctctattatgatatgcgaaaagtgcggcggggggtctgaccaccaaagacaaaataaaagcccggtaaaatccataatggattttaccgggctttttggaataagcagacaacgggaatcgaacccgcctcctcagcttgggaagctgatatactaccgatgtactatgtctgcaaaacacatactattattatagcgtaaataaaaaagattgcaaccactttctgtgagagatcagtgttgaagtggagatgaatatgatataatgaactctgacgagttcatattagaagttcctgcggaacttcggatgcgcagaagtcggcgcagaaaagaggatataatgttcgcgaaggcaaaagtgggcatgaaacaaagacgtggatgatagggcgaatacccgtcagtacgggaaatctttgatttcccgtaccggcactgcgatacaggaagagggaaatccaatgaaaacagttgcaatcgtggcgtgttccaacgggcagaaagaagaatatcgaagccagaacgaggaactggcacggtatctggaggaaacgggacacaaggttttatggagcaatgatatctatgaaaaaaatgccgcattttcaggtacgggagcagagcgcgccgcggaactgatgcgtttcttcaatgacccggaggtggaggagatctatgacatttccggaggagatctcgctaatcaggtgctggacgggctggactatgccgccatccgaagaagcagggcggttttctggggctacagcgatctgacgacggtcatcaacgccatctatgcacagaccgggaaaagcagcgtgctctatcaggtcaagaacatggtctggggagagggaaaagaggtgcagcggcggagatttgagaaccgtgcggcgctgtttgacccgcaggttcgctttgtgcagggggagaagatggaaggcgttgttgtcggcgggaatatccgctgctttttgaagctgtcgggaacccgctattttccggatctttgcgacaagattctgctgctggaagcatacggcggcgaagtgccgcagatggcgacgtatctggcgcagctaaagcagctgggggcgtttgagaaggtcggaggaattttgctcggaacatttacggcgatggaggcgcatgcgtgcagcccggatatcactgcattggtgagggaggcggcagggacgcagattccgatcgcaaagacacaggaaatcggtcacggaaatgacgcgaaagcgatccggatcggagaaaggatatactgcggcggagacgaagaatgtcgaagcgttgttacagatgctgaaaggagacagttggaaaccagatgaaaaaagagatgacatacacagaactagcgaaagagacggcaatcctgacggctgccgtggcgattatcgccacagccgtatacttttttctggtgccgagccacgcatccgtcagcagcatttccggtcttggaatcgtgctgtccaattttataccgctgccgttgtccgcgatcacgatgatcttaaatgttgtgcttttaattatcggattttttacctgcggaagggaatttggcgtgaagacggtttacaccagtgtggcgctgccggtgtttctgggaatttttgagagaatcttcccggattacgaatcgctcaccggcagccaggaactggatgtgctgtgctatattctggtggtcagtgtgggactcagcattctgtttaaccggaatgcgtcttccggcggactggacattgtggcaaagatcatgaacaaatatctgcatatggagctgggaaaagccatgtcgctgtccggcatgtgtgtggcgctttcggcggcactcgtctatgacaagaagacggttgtgctcagtatcctcggtacatatttcaacggtattgtgctggatcattttatttttgaccatgacatgaagcgccgtgtctgcatcatcaccgaaaaggaagaagaactgcgcaagtttatcatagaggatctgcacagtggagcgacgatctatgagtcgatcggtgcatacaatatgcagaagcggaacgaaatcatcgccatcgtggacaaggcggagtatcagaaactcatgaattatatcagtcgtgaggacccacatgcattcattacggtatacacggtgtcagatatccgctatcagccgaagcggcagcaatgaagaatgcgatacaactgttgtaaaagggagaaacatacatggaaatctatgataacgcagacagttcatacaaaactgccggggcggaaacctactatctgccggttctttatacggaggacgagcgcagcagctacgccgcatggggcatcaaaaaagaaaaacagttgatgccgtttgccattgtgacgatcatcattgacgcgtttgtgctctgtgccacggtcgtttatctgtttgcggtacagcggcagacgccggcattttccgtctggctttcctgttggggcggtgtggtcggcgatgtctcctacggtatggcgctggtcttgacggttcttattttaaagccgcttgactggctgtttgataaaatcatgcacagaccggagcaaccaaagatgttacaggtgacgccgaaggaaacgggcgtctcgtatctcattcttcgcggtacaacggtacttgcgcaaggactgctcccgtggaatgcgtgggaggctgcgctcactgtggagacgaatgagatattgctcgaggggcagagactgcggatcggaagcaatacgatcgcatcgatctatccgcctgagaaacagaagccgtggatggatcatccggcggagcagataacgggaaccatcagcctggcgcatatccggaaaaatatgcaggggtaccgggcgtccctggaagaacagaaaagggaagcagagtggagacggcagaatccatagatctgccggtggaaaataaaagaaaatggagacagacacagatgagatatccgaaaaatttatccgaacatggaacgatcggttttgtggcgccatccttcgggtgtgcgactgagccgtatcacaccgcatttttgaacgcacagaaaaaattccgggaaatgggacatcccctggatctcggaccgaattgttatgccgactgcggaatcgggatcagcaacacgccggaggcgtgcggcagagaactgacagagtattattgcagcgataagaatgaggtgctgatctcctgcggtggcggggaactgatgtgtgagacactggacgcggtggattttgaacagatccgggcagcggtaccgaagtggtacatgggatattccgacaatacaaacatgacatatcttttagcgacgctctgtgataccgcatcgatctacggcccgtgtgcggcagcgttcggcatggagccgtggcatccgagtctttcggatgcatatgcacttctgcgcggacagaagcatacggtaaacggatatgatctctgggaaaaggaaagcttaaaagatgccgagcatccgcttgtgccataccatgtcacggaacagcgaattttgcatgttttcccggaaccgacggaggcacttacggtgcagggacgcctgatcggcggatgtgtggactgtctggtgaatcttctggggacaacttatgataaaacaaccgggtttgtggaaaagtataagaatgacggtatgatctggttcctggaatcctgtgatcttaatgtgatggcgatccggcgggcggtctggcagatgaagcatgccggctggttttcccatgtgaaagcttttctgatcggaagacctgccgtctacgggcaggaactgatggggctggaccagtaccatgcggtgtgggatctgttgaaagattacggggtgccggtcgttatggatgtggatatcggacaccttgcaccgatgatgccgctggtgtgcggaagctatgcaacggtgcaggtgaacggaaatgacatctccgtgaagatggaatatttatagaataatgttaatatttttgccgatgccggtgtttaagagggtatccagatccagactctgggatacgatctgtgccgcggtggtgacagtgccatcatccagtttctctgtggtgccggatgaagtggtgccgtctgctgcggaagaacctgtggcagcggcattttttttctgcatcagcaggttgttatcagaggtaacgagcgcctcaccgcggtttgcaaaccgtttggcatacgttgaagtgcgctgcatgtaagtcgcgtcagcggaaaacagttctttgaacttggagagatctgcgctttcaaacagggtggtacggcttgtgagcgtgccgtcatcattgacggtgatgccgatcttgtcaagttcggaagaatattcgcttgtaatatttttcaactgctttgcattgcgctctaaggtacggtccgaggaactgccggcagaggaaagcatgttgttgtaggtctggatataggcgagcacgctgttgcgcgtattggtgccctggtcgtccgaaaaatcagaggatgtcagccggcgcactgccttgcggagcgccctgccgtcggcgagagcgagctggttgccgctgaattcacggcgtttggaggaagtgccggcttcccggtcggaacggtagaaactgcgcaggtaatatttggaacttaaggtggtgccggatccgatatacgctgtatttgacatagtgattcctccttaaaaagattctctaatatgtttcggcagaatgcggcatagaattaaccatagaaaacaaaaaacggatatgctatactaaattccaaagaattcgcctgaaagcaggaaatacgaattctggtaaatgggatgtgtgagaggaggatatcatatggaagcaatgatctggataggtctgataattctttttgtgttggttgagattgcgacggtaggactgacgtccatctggttcgcagggggcgcgctgatttccctgattctgtgcctgtgcggcgtgggactgggctggcagatcggcgtatttttcgtggtctccctggttctggtggcatttacccggccgtgggcgatgaagtatttaaagccgcacctgatccggaccaactacgagcaggcgatcggtgaaaacgtgtgtctgacggagacggtggataatcagagaggaaccggcactgcggtctacaagggacaggagtggacggcaagagccagcgaggatggaaaaagatatgaggcgggaacgatcgtgaaggtaaaggagatccgcggtgtgaccatgtatgtcacggaaagcggactgatgccgcaggttccgacaccgccgcagacagagcaagaggcagaataatatgaagcttggaatggtatttgagggaggcgccaaccgtacggtgttctcctgtggagtgatggatgcgtttctggaggaggggttgatgccggattatctgatcggcgtctccgccgggattgcgtacggtgtatcctacctgtcggggcagaagggcagaaatatagaggtagtggaaaattatattgcggacaagcggtatatgggcatgcggcatctttttaaccggaacgaaaaagcgtattttaatacgaagttcgtgtttgaggaagtgccgaatgaactgattccgtttgactatgacgcgtttgcggcgtatccgggaaaagtcgaagcggcagtgaccaacattcataccggaaaagccgaatatgtcgaagtgccgaggggacgggatatgcgcgatacgctggtggcgagctgttcgctgccgatccttttccagccggtgaagcttggcagacattattatctggacggcgggattgccgattccatcccgtatgaacacgcattggcggagggatgcgacagactcatcgtggtgcttacaagagaacgcggatatgtgaagaagacggagaaagcagtccgccttacggataagctgtacaagaaatatccgaagattgtggagagcatggattcccgggcggagcgctacaatgaatgtatgaccagactgcaggaactcgagcaggagggaaaaatcctcgtcatcgctccggaatccacttatggggtgggacggacaaccacggacgtcatcaagctccggagactttacgacgagggttatgaactgacagaaagaagcatgcaaaaactgcgtgcatatctgggataagaaagagagaaaacaaacgatgaagattgtatttttggatgcaaagacaattggtgacgacattgatctgtccggttatgatgctcttggtgaagttgtaaaatacggattttccacacccgaggaggcaagagagcgcacccgggatgcggatgtgattgttctcaacaaagttgtgatcaacgagcagtccatcggcgaggcggagcacttaaagctggtatgtgtgacggcgacgggaaccaacaatctcgacaaggaatatctggatcagcgcgggattgcatggcgcaacgtggcgggctattccacggagacagtggcacagcatacgtttgcgttattgttctatttgcttgaaaagttacattattatgatgagtatgtaaaatcagaaaaatatgtgggagatgtttcctttacacattttgacaatgtgtttcatgagctgagcggaaagacatggggcgtcatcggcctgggcgcgatcggcagaagagtggcggacattgcgggtatgttcgggtgccgggtgctctactattccacctccggaaagcacgatcagccgggatacgagagagtggattttgacacgctgctcgcggagtcggacatcgtgtcggtgcatgcgccgctggatgccaacacggaagggcttatgaacgccggggcgtttgcaaaaatgaaaaaatctgcgattttcctgaaccttggaagaggaccgatcgtggtggagaaagatctggcggaggcgttaaagaacggtacaatcgctgcagcggggctggatgtgctctcggcggagccgatgcgggcagacaatccgctgcgtgagatcaaggacagtgataagctgatgattacgccgcatatcgcatgggcaagcattgaggcacgcgcgcgtctgatgaagatcattgagggacagatccgggaatttttccatctgtaaaagaatgcgcctatttgggggcgcatcagcttggaatctgcgcatccagaccgctgtggaaggacagattgccgtattcttttagaaattccagagtgagctgtttctgcagctcactttttggttctgtatgcagtaatgtgtgaagctttcgcatcatggtaaggcagcgcgcactgcttttttcgtacagatcaaaaaagctttctgtggagacgcgtgtggcatcccagggattcttccaggaggcatgcctcaggttaaaaggatccgtgcggaaaaacagtgtgtcgctcggtatcaacggggaaaataacgggtatcccagaaaatgcttctccatgaaccggaaaagaacctttttttgtccggtttcatcgtgaagaatccgcatgccgagcggaagcgagatgattcccatccacatggtgctgcgatgaatggaaagttcggggaatgcgtaatgataggcatcgtacaggagcccggcaatcacgcgtttctgggcaaaagtcagctggatcgtatcggcggcgtggaattcacagggtgtcttgtggcgctttctggcaagcagttcggtgtcgatctctgtctcgagataggcatgtctggaaaaatagcttttctccttcttgtcatggtaatgcgtcatggcatagatatagggatggcatgtggtgtcgagcagatagtgccccaggaaaccggagatgtaggcttcggcaatgccccggtctgcggcggacgagagacgcccgtaactttccagcagtccgtgaaaaaaggcacgcggctccgtggtgtgtgcgagggcaccgagattgtggcggtgcagggcataggacggaagataatagaaaaacagatccggtccctgcagtccgaacgcataagcgctgcggttataaaacagattttttttctgggaattacattttaactggtgatagatttcttcgccaaacagataatgtgtaacaaaacctggcatgggaattcctcctttcgttcatcatgagtataaccattttacaggaaggtgttaagtgaggaatggaagatttaagaaaaatgtaataaaacaaatagattgacaatcaaaaaaagagtgttatactatcacgtagtaatggaaactatataatatagttcggcgataatcaaaacagtcagattgtcataagatgatagacaaaacaaggaaaatgtatatcgggtggcaacacttaaaatgcattgcatatgtaaaaaaagagcagtattccttatactttcatcttagaaaagaattagtgtgtatggaagaaaacggaggattaagtgatggcaaatttagcacagtcagtagagagaaaggcattcagcgtggcgattgatgcagcattgaagcatctgaataaggatcgtgaaaaaggcctgcttcagattgttgatcttgcagaaaagttcatgggcgataacttccgtaaggaagcgtatgacggagccagaaagatgattcaggatccggacaataaatggatgcattatgtaaatcgtcttctggatgagaccgatccccatgtagcaaagatgacagcattaaatctgggatatcaggcagcatttgtgggaacgaagacgattcgtaagatgagggaagtacataactgtaacatcccgtggctgatcttaatggatccgaccagtgcatgtaacctgcgctgcaccggctgctgggctgctgagtacggacacaagctcaatcttacgtttgatgagcttgacaatatcgtgacacagggtaaggagcttggtatttacttttatatgatgaccggtggtgagccgttagtcagaaaagacgatatcattaagctctgtgagaagcacaacgagtgtgcatttcactgctacacaaacggaactctcgtagaccaggcattctgtgacgagatgaagcgtgtcggcaacctgtccttatccatcagccttgagggatttgaggaggccaatgatttccgccgcggcgaaggtgtatttgacaaggttcttcatgcaatggatctgcttcatgagaacgggctgatcttcggtaacagcgtatgctacaccagcaagaacatggatgccgttacatcggatgagttctttgatcttctgatcgagcacgggagccgtttcgcatggtacttccatctgatgccggtaggtatgaaggcttcaccggaactgatgccgaccagagaacagagagaatatatttaccacagaatccgtgaggtacgtggatttacaggcggtaaagagatcttcgttatggacttccagaacgatggagagtatgttggcggatgtatcgccggaggaagaaactactgccacatcaacccgaagggtgatgttgagccgtgtgtatttattcactattcaggagcaaatatccgtgagaagtctctgttagagtgtttacagcagccgctgttcatggcgtacagagacggtcagccgttcaatgagaacatgcttcgtccatgtccaatgttagagaatccggagctgctccagaagatggtacacgagagcggtgcacactcaacggatgttgaggaggcggagccggtagagcatctttgcggaaaatgtatggagtatgcatgccagtggaaagagacagcagataagctgtgggcagagcatccgtaccagcagaagggctacaccaactttaagaaaaaataaggggcgatcgttatcagcaaggcgaaaaaacagatcttaaaatgggcattggtacttgtcatcatcggaatcattgtttatacattccgggattcagcaggaccgatcttagaacaattagaaaaaacgacaccggcggtcattgcaggcatctgtgcaatgactgtcgtgtatcactgtgtcgagggcgtgattaccacgctgcttgcaaaacaatataatcgtgaattcacattaggcatgggtattaccaatgcctttttgtgctctttttaccgcgtggcgacacttggcagcggagcaggggttgccgcgattgtctatctgggagagcacggtatagagtattccaagagcttcggaatgtatatgctgcagtacgcgtttcataagatcagtatcgcgtttttctcaatgattctgttcgcactgaactggaattatatgcgggtacattttggggagtatatgtggctgctgttggcgggatatcttgtaacgctgatcatcaccgtggttttaattctgttcagctgttccaggcagtttcaccgcatgttgctttgggtggtggatttcttcaatggaaagacgaaagggcggtttgatccgcaggcagcaatgcttcatgaccagtgccagatgttggaggatgcatccagacagttgatgggagagaagcggctggttgcgggtgcagtgggattgaacctcatcaagttcgcattctggtattccatcccgtatctgatctttctggggcagggggagattacgctcccgcagacgatggcggtcacatcgctttctgtcatgcttgcggcagtcattccgtcaccggcgggaatcggctctaccgagttcgtctttactgcactcttttccggaattgtcggaaccggactggcaggctccgcgtcgcttctgtaccgcttcggtaccttcgtattcccgtttctggtgggggcggttgtggtcatcatacgccgcatctacctcaaaaaaacgggacaagccaaacgatagcgccgcctgtgatatgaggctggtacacagggcggagaatagactggcagtgatacgataacagtaagtacagcagagttccagaatagaaacagtgcgtaggaattcggatcgcaaaatacggaatttctaactctgccgctttttacatctgtgatgatccgtgtttttccaagttttgagcactccgcgggtgtgtccgcaggccgacagacaatttaaggacttttgtgtgttccttacatcaccaatgaacaaaacataaccgcgcgaagccgatgtctgaattggcatctgccttattttcaatagcagatgccaacgagtttcggttcgcgcggttttatattgtctgtgaagcggtgatgttaggaacactaaaaagtccgctcattgtctgcggcgtgtcggacacatcccgcggattgtcaaaacgtggaaagacacggaattggatataaaaagcggcagagaagaaattctcgcattttgttccaacgaatatcctatgcactgtttctatctggaactttattgcatcttacattttattgtgaccggcaatctattctccgccctgtgtgcgagcctcattttgcgcctcttttgaaaagtttaaggtttgggaaattgacaaacgcacaagtcatgataaaattaacgttggcatgcaaaaaatatgtaaagaaagcgtaaataaggaaacatatgaaaataaaattatattttgacaagggtaatttgggcagacttgcggtggcgatgatctttgccgcggtattgttctggaaaatcggcttttcggtgtgggcgctgccggtattcggagcgtgctacttcctatttaagagcctggaggtggaactgtcagagaagatcccgtgggtctggaccggactgatgatcggcgccagcagtattttcacggcgtatcatgtgcagtatctgctgctggatgcagagcttcgcgccaagatcacacagccgaagatgctgctcaatatcttgtgctgtctggtggtatttctggcggtacaggtttttaccaataatacgggacttacctgcatgatttcccacatttttctggtgtcattggcgggaatcaactatttcgtatatctgttccgcgggaacgaatttattttcagcgacctgaaatccatccagaccggactttcggtggcgggcaattatgagttcgtgatggatgaccgggcgggctatgtgattctgatttccacgctctatgtggcgctgatccgcaagcttcacgtttcctttaaaaagagagtgccgatggcgatcatctgtatctctcttgccgtgctgagcggcgtgtatatcggtcataagacggagtacatagtgacagagacctgggagcagaaaggaagctaccgcaacggatatattctgaattttgtgctgagtgtaagagattgttttatcgctgcgcccgacgggtattccagtgaggcggtgaaagcgctggaagaacagtattctggcggtgatagcggcgggaagaagcagggagagaaagacgctgcctcggcatatgcggatgtggcggctgatccgggagaaaagccggccattatcgtggtcatgagcgagtcgtatgcggatctttcggtggtgggagatttttccacgaatattgatgtggcgccttatttccactccctgaaggagaatgccattcacggatatgcgctgtcttccgtgttcggtgcgaagacgccgaattcggagtgggagtttatgaccgggaactccatggcatttctgccgagcggttccgtggtataccagcagtatatttccaagacgccgacctcgattgtgtccaacttaaagaacgacggttatacctgtgtggcaatgcatccgtactatgagaccggatggagccgcaatgcagtgtatccggatctcgggtttgatgagacacattttatcgacgattttgaccagacgaagcttctgcgggaatatattaccgaccgggaactgtatgagaaaatcattgaccgctatgagagccgtgcggcgaatgaggatctgttcatcatgagcatttccatgcagaaccatggcggttatacggaaaagtacgataattttgatgagaaggtacgcctgctgggcttaaactatccggatgtcaatcagtatctctctctggtgcacgagagtgattcggcgttggagtatctgatctcctattttcaaaatgtggatgatccggtggagatcgtatttttcggcgatcaccagccgagcctttcgtccagcttttatccgaacttaaacggcaagggactttcgggactgaccgaggatgaactggaagatctgtatacgataccgtttttcatctggacgaactatgagagcacggaggtggaactgccggtcaccagcatcaattatctctcgacgctggcactggagagggcaggaatagagcttccggcgtacaatcagttcctcgcggacatgatggagaccattccggcaatcaattccagaggctattattccaagtctgccggaggatttttgcatatcgaggaagcgacgggggaggaagcggactggatccggaactataatattttgcagtacaacaacatgtttgacaaaaaggaaaagagtgaagtattctttccttatctgaaatagtatcaggaaagcaacagagatgtagctttttagcgggcaatgtgtgtaagaaaaatgtggaggcaaaaaaatggagagagtgacacttggaaaaacagggattaccgtcaataagaacgggtttggcgcacttccgatccagcggatcagcacggaggatgccgtgaagctggcgcgaaaggcatatgatgccggcatcactttttttgataccgcgcggttctacacggacagcgaggagaagcttggcgaagcgtttgagggcatgcgggaaaaagtctatattgcgacgaagacggcggctgccaatgcggatgaattctgggagcagcttggcatttccctgcacaatctgcgcacggattacattgacatctatcagttccacaatccatccttctgcccgaagccgggcgacggaaccggactttacgaggcgatgctggaagcgaaggcacagggaaaaatccgccacatcggtatcacgaaccaccggcttgccgtggcagatgaggcgatcgagtcaggactttatgagacgcttcagttcccgttctgctatctggcgacagagaaggacatcgagctggtggagaagtgtaagcaggcgggaatgggatttattgcaatgaaagcgctctcgggaggattgatcaacaattcggctgcagcgtacgcgtttgaggcacagtatgagaatgtgctgccaatctggggcgtgcagagagagcgggaactggacgagttcatttcctacattgaacatccgccggtcatgacggaggagatcgcagcggtgatcgagcatgacagaaaagaactctcgggcgaattctgccgtggctgcggttactgcatgccatgtcctgccggaattgagatcaacaactgtgcgagaatgtccctgatgctgcgccgcgcgccgtcggaggcacagctgacgccggagatgcaggcgaagatgaaaaaaattgagggctgcctgcactgtaacaaatgcaagagcaaatgtccgtacggactggacacaccggcactgcttgcgaagaattacgaagattacaagcgggtactggcgggagaagtcagcgtaaaataagagatgcgcagacatgcagaacgacatgcaatgcgcgtaatgcacacgtgaggcgaagaggagtgggagaatgaagaaatacgagacagtcatttttgatctggatggaacacttttgtatacactggaggatctgacaaaagcgacaaactatgcgctgcgcaggatgaatatgccggagcgcacactggatgatgtgcgccggtttgtcggaaacggtgtggcgcgcctgatcgagctggcggttccggagggaacggcaccggaagtctttgagcagacgcttgcgattttccgggagtattatgatattcactgcaatgacaatacaaaagcctatgacggagtgattgatctgctccgggaactgaaggcggacggatatgcgcttgcgatcgtgtcgaacaagccggattctgcggtgaaggaactggcggagatttattttgagggaattgtgaaagtggcaatcggcgagagtgccggagtggcgaaaaaaccggcgccggatacggtctatgcggcattaaaggagcttggcatgccaaaggagggcgccgtgtatgtcggagattccgaggtggatgtgatgacagcgaaaaattccggtctgccgtgcatttccgtcctgtggggattccgggaggaagcgttcttaaaagaacatggtgcagatcattttgtccgcgaaccggaggagatcagagatttcctgaatgcgtaggtctgttgagaaatgtttcacttttggtaaggaagtaccattgcatgatttttgtacataaagtacaataaaaataatgagaaacacagaagagttgtgcggaatcacaacaaggaaggcggcatggtatgaacagaagaagtgtgaaacatacgttaacgatgacctgtctgatgctggtattactggcatccctgttgcttggggcaacttccattttcagtatccggaatacgaccaatatggcgctgacggaatatgaaagtgcgatggattccggttacaacacagagatcaagtctgaggtccagacggtgattgctgtgctgcaggcagaatatgataagagccaggcaggggaactgacagaggaagaagcgaaagcagaagcgaaggagatcgtccgcgccatgcgttaccgcgatgacagaagcggatatttctggattgatgatacggattacaatctggtaatgcatccgattctggcggagcaggaaggaaataaccgctacgatctggaggatcagaatggtgtcatgatcatccaggagattatgaaggtctgtaacagtgccgatggaggcggattcaatgaattttactttacgaaggctgacggtgtgacggttgcgccgaaggtagcatattccgagttgtttgcaccgtggggatgggcagtctccaccggtaactacgtcgatgacatgcaggtagagatgacgggtgtggaaggacgcatcaaccagaagttcgaggttctctgcattgtgatagtcataatgatggctgttatgcttgtgatggcgttcgtgtgggcgagaatctatgcggcgaagctctgcaagccgctggtggagatccaggggctggcatccagactttccgacggagatctgacaacgaccgtgaacgtaagggagaagaacgagctgggagacacggcagaggcactcaatgccgcgcagaagcagattgtttccctgataggaagcatcagcacggcatcaacagatctgcggaatgcactgcagtcgtttactggtaatttctcctcgatgcaggagtccatcggaaacgttgcggttgccgtcaatgagattgcggaaaacagcacgacgcaggcaggatccacgacggaagcgtccaacggtatcatgacgatcgcggaaggcatcgagaagatctccagcgagatggaagaactggtcggcaatgccaatcagatgcaggagtattccgataagtcgctcgctaagcttcgtgaattgatcgatacgaacaataagacagaggcggatatcgagtcgatgtatacacagacggagagtaccaatgcatccgtcaataagatcagcaaggcggcgacgctgatcagtgagatcgcagatcagacgaatctgctttcactgaatgcttcgatcgaggcggcgcgcgcgggagaagccggacgcggatttgcggtagttgcggaagagatcggaagtcttgcgacacagtcggcagatacagcgcatgagattaacgacattatcggagagctgacagagaattccgagaagtcgatgggcattatggtacagatgaatgatgcgtcgaagcagcaggtagaggcgctgaatcataccagcgagatgtttctggatatgcagaaggcactggaggcgtgcacgaattccatccgcgtggtgacggatatgatccgcactgcgaatgaggagcgtgagaaagttacccagagcatcgaggtgctgacgcatcttgcgacagataatgcggcatccacggaggagacttccagtatgacaactgagctggagggaacggtggagcgctccagtggaatgatcgagaagctggagggcgacatgaaagtgcttgcagacagcatggagcatttccggttgtaggaagactgcggcaagaatacaaatgataagatgagaatgaaagcgggcgtgtcagaaactgacacgcccgtaatttcatgtctgcagatattctgcgaatgtgaatatatactgggtacgaatagggaaaaaaccttttatatttcacatgcggcatcatatgctgatttaatggcatgatcgatattgctcggacgctctccggcacaatcgccaatataatgaagcgggagcggacaagccgaaagatccggaagattctttcttgcaccaacagccattacaacgaaatccgatctgatctctaagaccgaggttttttcattttctgttttctcaacaataactgcatggtcattgatctctgatagttttgcagaggtaaggatctggacattggaatgctctaattcactcatcaaagttgggagaatcgtgctgctttcttcctttgcaatctgatccatcatttcaataattgtaacgttacatccgcgggcagcaaggtattccgcagtttcaacacctacaagaccaccgccgatgacagatacgttgccgaatacaatttcttttttagcaagaatatcccatgcacttgtaacgattggaagatctttgcccggaacgggaatgattgcattcgttgcacctgttgcaacaattacttcatcaaacgaatcatagtcttttccggtaaattcctgacccagacggaatgtcactgataattcgggaagcacgttaagatagtagttaatgcttctcatcatttcttcttttcggggtggaacgctggcaataagaagctgaccaccgatctggagtgacttttcaaatatagttacctgatggcctctcagagcggcgacacgtgctgcttcaagtcctgcaattcctgcaccgataattgcaattcgctttgctgtgactgcaggagtaatctgacggcttgtctcataaccattctcggcatttaatacacagcttaggaatgcacggttttggatattgtctgtacatcctttattacacatcatacatgttctgacatcgcagcagtgtccatcggcacacttgtttgcaaaatcaggatcggtaagcagtgaacgcccgagtgcaacgatgtcagcagagccatttgtaataacggcttcagcagcttctggtgttacaatacgaccaaccacggatacgggaatggaaacgagttccttgatttttttagagtatgaaaccataaaaccatatggctgtgtccccatagcaggaatggtatcccccatatttccggtgtggttagcctgcgcgacatgcaatgtgtcaacaccggcagcttctaattcttttgcaaaaatgcaggcctcatcaagtggaagaccaccttttccccgaaagccgttatctccaagaggagttacgattggaagcttgtagtcgataaccatatctgggacaattgcttttaaacgtcgtacaagagttaaggcgaaacgtgtacggtttgcaaggtctccgccatattcatctgttctgtgatttaaaataggagagcagagcgatccgacaaggcggtctccatgtacttcgatacagtcaacgcctgctttgtgggctaaaacagcacaattttccatgtgcttaataatttcatccagttcttccgcagttacttcatttacaaagtgctgcatatcatggtgaagtttggctcttgcctcctgcatttttccctggtgaaacatttcgtttaaagctgcgacgttatagtctggatggaacagctggattccaagctttgcaccgtatttatgacatgcatcggcaagccgctggaagccttctgcctgttgaggagagtaaagttttggtgtaggagagaatgttgaaagaggagcaacgtctccaatgacaatgtatccaacaccaccttttgcaaggcgctcatagaaacgaaaactctgttcgccgatagatccatctttttcttcgtatcctgttgtaagtgggggaaacataatacggtttttaaattcaatgtttccaactttaatgggctctaataatttcattgtgcacacatcctttcaaagtgattatcttatttcaatggtgttaaaaactctaatatgagcctgtctaattcagctcttgcagaaccgcttgcaaagttgtgatttgcgccttcaattgttttgtaactgcatttgccattatagagtgcttcatatcgatgacaggtagcatcatctaccagatcgtctgccgttcctctgataagaagaacagcacctgtatatcccgctgcggatgaaaacggttcatactgatataaatcatggttaaaagaagtagggaagcaaagcccttctatatctgcttttgtgattccctgtgcttccattgcctcggcgcggtctttacatccaaaccacatgccggctcccgggcacatgagtatgagagcatgtggattaacgataggcgcagcagtggcagctgcatagccgcccatgctctggcctgataaaataattttatcaggattggcaaaatcctgctgttttgtccagtttataatatcttcgatatcatgtaagataccggtgaatgtcatgtcctcgaactcaccgtcgctttcgccatttccgtataaatcaaagcggacgctggcaaatccgttttcagccagaaatctggctgtgtgggtatagatatttttgtatccgcttttatttccggtaaatccgtgtacgttaatgatggcggggaagcgcgagccttcatccggaatatttacaattccgcgtaagacatgacctgagcggtttgttatttcaacttgttttgtcaatgcaagatacctcggtttctgaagttattctgcgtttgcagcatttcgtttgtctgataaattctgtaacatttcagctgttttctcttttgtaagagggtatacaaactttaatacaagtacagctaataagtacccggctacatataatccggtatatgttttccagagacgtccggagaatgcttcgctctgaacggcctcatttacgttaaagcctgcgattgcaagtgcaaagctgctcatacttccggatacggcattagcaagcttacggaaaaatgtatatgcagagtacacgataccttcgttacgttttccggtctgaagttcctgatagtcaattgcgtcatttacaagggcccagactaatacctggaaaccgctgacaccaagataacagattccgttgataataataaagagcattgggttctcaagagggaaaaagaataaaatagcataaacaacaactgagaaagttgcactatacataatccattctttctttccaaatttctttgcaacaaattttgtcccaatgaatgcgataagcgaccagataacgcttaacatgcctgaaactgccataatggcgacatttccgaaatagtcacggaataagtaggtatttaagccgtttaccataccggcaccaacgataccaataaagctggataacataacaccaagtaaagctttgtttttggagatggctttcagcacgtctaaatagttaagcttctctttttctttggcaactggctcggtgataatacgctccttgcaccagtgtgatgtaaacataaggcagatgaaaccgataacagcacagatggctgccataataaggaagtggcttggtacaggctggttgtctttgtataagaataatggaccggcaataacgatgacggtcataaagattgtgccgccaagacttctgaagcgtgaaaggtcggtccgttggtttacatcatctgtcataacacttgaaagacttccaaatggtacgcttacacatgtgtacataatttcatatacaacatatgtgatgaacatgtaagcaagacgggcaccataagcaaaattacttacgttgacgaagcctaagatacaaaggactgcggttggaaaagcaaagaatttaatccacggaatgaatttgcccttacccttgttctggtgactgtcaacaagtgcaccgattaatggatcgtttatggcatcccaaagctttgtgataagcataaggattcctacgtgcaccgggttgaccttcagcaccagggtataaaaaatagcaagatacatggctcggaactgttctgtacagcaacatcccaaatcgccaagagtgtaaccgattttgtccttcatggaaaatggtcttgtttctttcataataaaatacctctcgtttttgtgttgttttggtagctacatgttcattatatggggattagagagataaacatatacaaaaattgcttgcaaactatggaaaattgatgtattgtataaattgacaaaatgaacaaaaatatggatgctggaatgtgcaaaattaacatatgaaaaaacagagttatgagatggaatatataaaaatagaagatagcggacagcgcagttttggacagaagaaaaaccatacaattatttttgtgacaggtggtatgggatatttacgtcaggaaaatgaaaaggcggtctgtaccatggaggacttaatatttattaagcctggcaataaagtgaagattgaatatcgaaaaaacaaatatccgttagaactatatgtgctctatgtgggaacagagttattgcagagcttatcagatgaaaatacaagacttgacgaggcatttgatatcgttccctttcaggttaagacagttcattctgagagtgaatctgccatgcttataaagaatatttccaaaaagctgtattcaatgcttaaggaatctcctaaatttgcgcacacattgtatgagaaaagcctactgacaatgcttctggtacttgcgttgcggtcgtctgtcaaggaggacgtacagctaaaattaaataagaaaaagcatgttgtaatggatgatattttcatatatataagagaacacctgacagaagatatatcattggagcgcctggaaaacgagttttatgtaagccgctatcatattgtgagagaattcaagaagatgacaggcgaaacgccacattcatatattgtaaagagcagactggatctgtgcagacactatatagaacagggaaaaagtatccgtgaggtttatgaacttggaggatttggcggatacaatcattttttcagggcatttaagaaagagtatggtgttactccaatgcaatattataaaaatctgcagatcgataggaatgaaagataaattgataaaaacagcagtatcatgtttgaaataatgcaatgggtagcggacagtttcccgaataaatttttcagttttcccatatactaactcccaagctaatatatagcaaataagagaggctttatctacagagatggaaacagacaaagcgctcttgcgaaaataaagcattggaggaaaatttatgaaagcaacgggaatcgtgcgtagaatagatgatctgggcagaattgtggtgcccaaagaaatccgcagaacgcttcgcatacgtgagggagatccgcttgagatatttaccgaccgtgagggagagattattttaaaaaaatattcgcccatcggagaattgagccagtttgccggggaatacgccgagagtctggcgcacacgacgggatatctggtgctgatcacggacggggatcatgtggtcgcggcgtccggcagtggcaagaaggattttgagggcaagcccatcagcggacagttggaggagatcatcggtgagcggaaaagtctggtagcttctgacgacgaaaaggcatttgtaaaactgacggcggacgatgccggcgagtacagacagcaggcaatcagcacgattatctgtgagggggacgccattggcgcagtgatcctctgctcacgggaagaacgggagaaaatgggagagacagagagcaaacttgcggcggcggcggcaggctttctgggcagacagatggaacagtagaacagaactggaaaaaggcatctgaaacagtgtgtttcaggtgcctttttgggcatatgccttgaaagaagccgggagacatggtaatctcataaagcaaatgagtttcatggaaagttagaaaggtggaaacatatgagcgaaaaacctgacgtgacgatgggggaaatgaccaaagcagatggaaagtctggcaggaaggtgccgaaaaaaatcatatggacgatcggcgtagtggctgtggcggcaattattttgatcattggaatttgcagcggagcatttttgagcagaagtaacaggattctgcttgcagcaagaaataccataaaagatctgcccacggttgttgagaataggaatgctgcagatattatagcatccgggaaatatacgattggtgtaaaaggggctgtcaggggaaaagactttgatggaacgtttaaatacaaagatacacagctgcaggcagggggaacgatttcacttttcggtagggagaatctggattttctggcaaacctggatgatgagcagctctgcgcaagcatcccgatgcttacagataatctgctggtatacaattacaaagaagagaaagacggctacatagtggatcttctgggagcggatggggttgcatcgatcgatgcggcacttcgtgaacttacctcgaaagaagaacagaacagagcggcgcaggagatcctgtccgtaatatacgatgagtacaagacgctcgatataaaaaaagcagaaaaagaagaattcatagtggacggcagcgccagaaaatgtaacgggtatgaatttaccgtcacagaggatgaacttctgcaggtaatggatggagtgaaggaggtatacgatgcgtattacggtggagcagcagatgcattgaagctgaagctgggggaggacttttcgcagctcagagatagagcatgcagtatgggggatatcaatgtaaaagtctatgtgtaccagaataaactggcagcggttgttacggaggcggaaaagtctgatacggcattccgcctgctgttcaagggaggagaatacagaatgcagaatctggaattgctcgcagaggatttggagggtgagcattccatactggaactgacaggaaaagcagcaggggaagaagggggctatgagtttttgattgataatggtgagcatgatataaaccttgtgatttcgatcagtggggaggttcaatttgaaaaaatgagcggcgacagaatagatgtgggcaacatgtctgaagcagatctgagaaaatttattttgcgtacggttggaacaatcatcacaagccacatcaggtaaccgcaagacggggataagaataccagtatcccggagagagatgtgacagcagccgggcgtgtgagtggagatgagactgtattacggtgcacggagattggaaagatacagagaagaacaaatatggcaaaataaagccaagatgtgtaattgttccacagtatggatctgtcctataatgaggacaaagaaaaaaggcggcgtctgacgggggagaagacgatcagatgctgcgggcagggggaaaacatggagaagtatggttttggcgtagatgtcgggggcacaagctgcaaacttggtctgtttacagacagcgggaaactgatggaaaaatgggagattccaacggataccagtgaacagggggaacatattatagaacatgtggcagcatcactggaacgcagacagagagagcgggggcttgcggatgagcagatcataggcgtcggcattgacacaccgggaattgccgggcgggatggagttgtcagaggcgctgtgaatctgggatgggaggcatgtccggtgcaggagcagttaaagatgcgcctgcagaaaaaggtctgtgtctgcaacgacgcaaatgcggcggctctcggagaactgtggcagggcggcggcagggggtaccgcgatatggtgatggtaacgcttggaacaggcgtgggcggagcggtcatcctgaatggaaaagtgctcgcaggcgcccatggaatcgcgggcgagatcgggcatatgaccgtgttccacaaggagattgagcggtgtgtctgcggaaaatacgggtgcgtggagcagtatgcttccgcaaagggactgatccgcataacgagaaaattattggagaaaaaggatccctacacgatactcgtcgacacaccggaactgtcggcaaaacagattctggatgcggcaaagagaggcgaccgtctggcactggatgctgtggaggttctgggaaaagcgcttggaagcgcgctcgcagccgtggcggaagtgatagatccagaggtctttgtgatcggtggaggaatcgccggggcgggagagatcatcctgcgtatcgtacagaagtattacagacccgatgtactgccggcaggtgcggacattccgtttgaactggcacgtctgggaaatgatgccggcatgtacggcagcatgaaacttctgctggacacctcagaggaaaaataactgccggatttctgaagcatagaatggcatatattttgtatggagagagagaaaacgataagttccagatgcagccggcagcgacaattctttggagtaaaatccgagtatttcttccgtgccacgtcggacatcgaattctgtgtctttccacgtttggacagttcacggggagtgtccgacaaaccgcagacaatgagcggactttctggtgccaacaagggggcacacacaaaagtcctaaaattgtctgcggattgcggacacaccccgtggaatgctccaaacttggaaaaacacagatcattgaggatgttcgacgcggcatggttagaaataccggattttgcgatcagaatgtcgctgccggctgtattctggaacttcgtattttctgacatctccatcataaaacatcgtccattccggcttcagaaatccggcagttatttttgggagagggtacatgccggataaacttgtgaaacatggcgcgacagtgtacaatagaggtaattaacgcagaacggagaagatgcagtttgaaatttatacatatcgcagacgtacatctcggggtaaagccggatcagggaaagccgtggagtgagcagcgggcgcggcagatctgggattcttttgcagatgtgatcggggtggcaaaaagagaaaaaccggagtttctgtttgtgacgggggatcttttccacgcacagccgctcaaaaaggaggtgcgggaggtcagccgccttttcggagagattccggacacacaggttcttttgattgccggcaatcatgattatctcagggaaaagtcgtattacctcgcggatttgtggccggataacgtgacagtatttaagaaagaggaagcggaagcagtcgattttccggaatacaacacgaccgtatacgggctaagctactggcacagggagatccgtgacagacggtatgatgatctgcgccctgtaaaccgcagcaggtgcaacatcctgctggcacatggcggcgatgagcgccatattgcgttttcggcggagcggatattacagaacggatttgattatattgcggcgggacacattcacaggagcggctggctcatgccgcacaaggcggtaatggcgggaagcctggagccgacagactgcaacgacaccgggccgcacggatactggatgggaacgttcggtgcagcgggggcagatgtgtatttttatccgctgcgccattgcgaatattgtcatgagatgtatcaggcagaccggaacacgacagaccgtatgctgtgggactgggcaaaggagctgttggagcagagaccggagtatcagtatttccgtctgtatatcaaagggaaaaaagatccggagtattcctttgatgtgcaggagatcgggaagctcgaccggattgtggatattacagaccagacggtgccggattatgattacgagaagctgctggaggagcacgcggattcgatacttggggaatacatacgcagtatgcgaaaaaaagaaccgggcgtctgcaccgcaaaggcactggagtacggtgtgaatgcgctgctcggctatgactgctgacggaatgcctgaagtatgacaaaaagcaaaggatgggacagacatgcagattgacagagccgcaatttttcgctttggaaagctggcagatagaaccgtggattttgccccggggatcaacattgtatatggaaaaaacgaagccggtaagacgacgctgcacgcgtttctgaccgcgatgctgttcgggctggaaaaaggccggggacgggcaaaggggacggagggctatctgcgctatgagccgtggcatgcaccgtcctattacagcggcgcgctgcagtttagcgtcggaggcagaccgttttatctggaacgcaatttttaccataaagaaccgagagcacgcctctgcaatctggcggacggggaggaactgtccgtcgcgtacggagatcttggaatgcttttaggaggggtcacccgggaggcgtatgagaacacctgtgatattccgcagtgccgggcggtgacgggagcagagctgaccggacttctggcagagtatctttccgatatgtcggacgggggcaatgcgggaatccgcgtgacgcgtgcggtggaaaaactggagcagaaaaagagaagcctgcagtcgcagatcaaaagtgaacaggagaagcgggaacaacagctgcagcagcttaccgtggagcggcgcatgctcgaggaggactgcggcaggcttcgtgagcagatcgagaaggcggcagcggatatgcgggcgtatgccaggatgcacccgcaggtgagagacggacagcgaccggaagatgcccgaactgcggaaaatgcggggactgcgtcagacagggaaaggagagctgacggaaacggttttcctgtgagaagcctttttctgggactggcggcagcagtgggactggcaggaaatgcatggtggtatcaccgcgcgggttatgcgccggagctgtttgcggcggcggaaggcgttcttgccattctgctcggcatcggagtggcaggcatactgcgccataggagcgcggggcaggcgcgtgcaggagaaaatgggaaggagacggcggaggcgccagagagcgcggcagcggaggacgcggtgcgcatccggcttgcggagtcggaaaagcagagcagacgcttgcttgcagggttggaggaaacactcgcggagaaggaaacgagacgatgcaatctggcagaacagctggaagtatgcagcggagcgggcgcacgggagagagaactccagctggaacttgatgccgtcgagatggcaaaaaatgagatcatccgcctgtcaagggaatacggggacgagcggagagatgagatcaacagtgtggtatccagatatgtctctgcgattacagagggaaaatacgatctggcggaagtggacgaaacgggaaagctccgcgtgcagacggagggaagagaggttttgccggaggcgctcagcagaggaacgctggaacagttctattttgcgttccgcatggcagtcggaagcattgtgacacaggaagaaccgctgccgctgcttctggatgaaacctttgcaatgtatgacgatgaccgtctgcggcagacgctgcggctgctggcggcgaacgggacgcagacgatcctgtttacctgccagagacgggagcagaagctgttggaggaactgggaatcgcatatcacatgatagagttatagtaccgtttacgttgtaggcaaagaggggcaggacggcacagcgtgacacgcgagaaaagggcagggaggaatacggtggctgcaaagaaaaagaagaaaaaatatcggggattctggatatttgtcaaagtacagtttgtcctttccctgctggtgctcggcgggctgggctactatgtccttggcggatatgcctcagaggtgggcagcatccgcaaggaagcggacagtctggtacggaattcgacggaggagacgttccggaggtaccgcacaagcgttgtgtatgcggctgacggcagtgtgatatccaggcttaatgaccagggagcgtcctattatctaaagcgcgacgagataccgcagcccgtgatcgatgcggtggtctgtatggaggatcagcgtttttaccagcacagaggcgtggatttcagagcgcttgtgcgcgcggcaaaatcactgcttgaaaaccggaagatcacgcaggggggaagcacgatcacaatgcagcttgccagaaatgtatttctgacgcaggagaagacctggcagcgcaaggtggaagagatttttattgcacagaatctggagaaaaaatataccaaggatcagattctggaattttatctgaataatatttactatggcaacgggtattatggaatcggagcagcaggcagcggctatttcgacagtgaggtcggggatctggatctctcgcagatcgcatttttatgtgcgattcccaacaatccaaccgtgtatgatccggttacccacatggatcatgcagtcgagcggcgcgaccggattctgggtaaaatgcgggatgacggcaagattacacagatggcatatgcagcggcggtagcggagaacattaccttaaagcggccggaggcgatggaaaaaaataattacgtggaaacgtacgcctattactgtgcgacccgtgctctgatggagcaggccgggtttgtgttccagtatcagtttgcaacggagggcgagagggaggcttacgagcaggcttacagcgaatcctacagcgagtgccagaagcagctgtacacggagggctatcagatttatacgtcctttgacctgcagcttcaggaggaactgcaggcggcagttgacgataccttatccgcttttacggagaaaaatgacgagggtgtttatgatctgcagggggcggcagtctgcattgacaacgatagcggctacgtgcgcgcgatggtgggcggcagggagcaggattttgacggatacacgttaaaccgcgcctaccagagctaccgtcagccgggaagtgcgattaagccgctcacggtatacacgccgtcgttcgagcggaattatacgccggagagcattgttgtggatgaaccggtggaagacggaccgaaaaatgcgaacggtacctaccttggaaatgtgacggtgcgcaccgcagtcgaaaaatcaatcaataccattgcgtggaagctctatgaagaactgacgccgcaggtcggtctgtcctatcttgagaacatgcatttttccaggctggatgcggcggattatgtaccggcgacggcgctgggcggctttaccaacggtgtgtcgcctctggagatggcggccggatatgcggcgctcgccaatgacggggtgtaccgcgagccgacctgtattatgcggatcaccggcgatgacggggcggatgtttatcttgcagcgcaggaggggcaggaagtctaccggcagaatgcggcgcggatgatgacggatgttttgaagggagtttttaccaacggtacggggcgcggacttggactgtcggatatgccgtgcgccggaaagacgggaaccaccaacgaccacaaagacggctggctggccggctatacgagatattacacgaccagcgtgtgggttggatacgatatgccaaaagagatggacagcctgatgggcaatacctacccgggaaaaatctggcagacatttatggagcaggcacatgaaggactggaatggctggattttctgccctatacgcagattccggatgcttcttccggggagacagacgcagaggatgcagcaacggatgagggaagcgcacaggaggaaacgccggcggagaatggagacacaccgcaggagaatgtgacggatacaccggacacgccacagggaagtgcgacggatgttccgtcatcttcacaggaaaacgggcaggggatatcggatacgccggatgccacacaggaacagccgtcagacgcttcgcagcagaatacaacaggaacgtcacaggaaaatgcatccgacgcagcgcaggaaaatgcagcgcagtcatccggggagaacgcttcggatacgccgcaggagacagcgcccggggcaccttaagagaatacaccttaacattgacagataagactggaaacgttatcataagcatgggtaaaggcatcggcagagtacataacggacagaaaacgatgcaaggatacaaatagggaacaggagaatggaagcatgaaaaaatatgcatttggagttgacgtagggggaacgacctgcaagatcggattttttgagacggatggaaagctcattgacaaatgggagatcaagacgaataaggaaaacggcggagcatcgattctgtcggatgtggctcaggcgattgagggaaagctgacagaaaagggaatctccaggaacgatgtgcagggaatcggtgtcggtgtgccgggaccggtaaaaaatgacggtgtggtacaccgctgcgtgaacgtcggctggggtgttgtaaatgtagaaaaagaacttggagatctgaccggactgaaggtgaaggcaggaaatgatgcaaacgtggcggcactcggcgagatgtggcagggtgcggcaaaaggctgcagagatgtcatcatggtaacgctgggaaccggagtcggcggcggcattattgtcgacggaaaagttgtagccggatttgacggagccggtggcgagattggtcatattacagtgaatgcacacgagaaggagcagtgtaactgcggacagtacggctgtctggagcagtatgcgtctgcaaccggagttgtgcgtgtggcgaagcgtaccctcgagaaggcatccgaagatactgcgcttagaaaacatgcagatctgaccgcaaaggacgtatttgacgaagccaaagcgggtgataaagtggcgcttgaagttgtcgatgaggtatgtggcattttaggagcagcactttccaatatcgcatgtgttgtgaatccggaggtcatcgtaatcggtggaggcgtctccaaagctggtgatattctcacggatgcagtgaagaagcactttgttgccacttcattccacgcatgcgccaacacaaagttcgtacttgcgggactcgggaatgacgccggaatgtacggctgcgtagagatgctcttagattaaaaagggctttcgcccgcgtgcatcgcactataaacgggatacgttttattatgggaagcagagactatcacgttccagatgcaaccggaggcggcaattctaagcgcaaaatccggtatttctaaccatgccgcgtcgaacatccttgatcatctgtgtttttccaagtttggaacattccacgtggcgtgtccacaaaccgcagacaatttaaggacttttgtgtgtgccccttgttggcaccactgaacacaacataaccgcgcgaagccgatgtctgagttatcatctgccttgttttcaatagcagatgataacgagtttcggttcgcgcggttttatattgtctgtgaagcggtgccactaggggcaccagaaagtccgctcattgtctgtgttttgtcggacacgccccggggactgtccaaacgtggaaagacacagaactcgatgttcgacgcggcacggaagaaatcctcggattttgcttcaaagaattgccgcctctggttgcattctggaacttcatattctccaatattcttataataaaacgtatcccgttttaaagtgcaaagcgcgggggcggcagtcctttttatagcgctgcctacgcttccacggcgcgtttgcggacttccgcaagtgcatgtgataccggtggaatgcagatgataatcaaggtgatgattgcctccggaacaaggtaggatgcctgatagccggcagaatatgccagcgggctcatgccttccggggcgtatgctgcgaaaaatacaacgccggagatcgttgcaaatacaaaacgtccgataacgccaacgatatatccgatctgaagtccccactttttcttattgaagaagccggcaagacccagagcaccgaatgccagcgggtagtccaagagcatctgcgggattgtgtagaaaatcggctccagtacgaactgcaccaggccgtaagccactgcggtcataatgccgacatacggaccataccagtaagcgatcagaacgatgaaaagcatggacagcagagtgacggaaccacccattggcatgtcgaacagcttgatcatcgaacacacaacggccagcgcgatcgcaacagcagagtagacgagctgctttgtggtcagtgcggacttgtgcgtggcgttcttgtggcgcacgatagcggcaacaatcagaagaagggcgatgactgcgatgacgattgcaataccgacggtagtcagatggacggaaccgtcaccccagccgccttccggtgtagcaaaaaagttattcataaaaaaatcctccttggtgaatatgtagccaggaggatttgtctgcgttattgcaaaaagcttccttacgccggtattatccggttcaagtaataagggtcaatgaacgatcatctctcagcagaatctgcacccctagcgttttcatattcgatattattataacgaactttactataacgattctatttggaattgtcaagtacgattgtgttcttctccagttcttctgtgagcggcgcaatctgtgtgagcagattggtcatgtcctcgaagagggaactcttggtggttccgagatcattggcgtgattgatatgctccataacagcgtcaaactgccgttcctcaaggctgaaggactggctgacttcgtccagcttctgctctgcggcggacatggcggttgtaatctgctggtgtacagtgtccgcaccgccggcagcggttgtgatctgatcgaacacttcatacgtggaatcaacattttccatactctggttcaaggcgtcctgcgaggtggaaatactggtattcaggttggcggtgccctgctcgacgtcgccgatgctgatatctaccgtgctgacaagactcttgatctcactcgcaagatttttgacctcctcggcaacgaccgcaaagccttttccctgctctccggcgcgggcagcctcaatcgaagcattcagggcaagcatgtttgtctggttggcaattgagatgatctgtgccatgcagtccttgatcttctgaacggaaacctggaaatcggaaaaggtgttctgcatttccaaaaagcgctcctgcacttctttggagctgtctttcaatccgtcaacacgctgctgtgcaagaccgacagagctggcaatgtcagatttgacggaagcaaattcaccggaagccctgtccacatcgccgaacagctcatgaaaggaatccagcttttcgcggagcgcggcattttcgtccagaacgagctggaatgcctgtgtgatggactgcagttcatctaaagagtgcacttcgctggtggagagctgcttctggtaatctaacaggcagtccgcaatatgcgtaacaggatgaagatctaagcggctggtggacgtggctggtgcagcagctgcattctttggtgtttttaatgaaaacatggaaatcctcctctttctatcacagattattcaaatacgacacaggtcatggtctggttgacgaactgctgattataatgttctccgaatccgatcagaccggcgtgatcaccgagtgtggacatggttttcagataatcttccatatggtgttcctgtgagaacagaaggtaacggaaaacacagttgatggagaaaacgccggaaatatggttgaaatcgcggcggatgcgctgcagcgtctcatccagaatctcgttgtaatcctgttcttccagaagaacgagcacatcggaatcattgacctgtctgtaacagcagagaccattcccggatacttcctttaaggaaataatacagatgtcctgtccgttcattttgccgagcggattgtggaaagtctggttgatgatattgctctcgctgatatgtaaggcatccatataagcctgcttggaagatttgccgtttaactcgccgacatagtatctgctgcggtcggtattggaagcgatgaagcggtagcctggcatcggtttgtagagattctccttgtagacagcaacttttcctccgttgtttttcacaaaagcgtagacatcggcgtcttcatagatcgttccgttgacagagacttttccgctatccccggtgccgccgacaagcggaattcccaccttgccgagaatgctgtggatcgtggtcagcacacaggcgtcatttccggtacacaggtcaatacagacggtatctttcgaacttgcgtggacattttttaaatcctgttccatgcgttcgatgtatttgacgggcatggtggatgcctgctccaaaacgttggcaacagcggtgacattgtcataaaaagcaaccagaccgactcccttttcgacgaccctggtactgtaactcatgccgatacagccaatgctcgggactcccgggaaaagggattccagttctgtaacgtgtgcctcaaactggtctgcgttggacatcaggataagaagtcccggagcgtgaacgccctgtgcagcttcttttaagtttcctgtctggctcattccaaaatattgtttcatcagcgaactcctcccacatcttattacgaatattgtaagcaattttgcatgatatttcaacgcattaacgcaattttagcgaaacgtttccaaaaaataccttgacaatcaaacaggacagacatatactttgaaaggcgaataatttgattatcaaaatatttgaaaagcaaataattaaaaggaacagggaaaaggagaagaaacatgttagaaaagatgagaccgatcattgcggagcagttaaacgtacaggagtctgagattaaagagaacacaaagttaaaggaagatctgggtgcggattcgctggatctgtttgaacttgtcatggcgctggaggaggaattcggcgtggagattccgtcggaggatctggaatcgatcgtgacggtcggagatgtgatcacatatttgaagaaccgcggggttacagcataggcgaagacagcagccgggacataccggtgtttaagggtaagaaaaaagaccggcaggaagaaaagaggagaagtatggaaacaagggtaagcagattgcttggaacaaaatatccggtcattcagggtggtatggcatgggtggcggaatatcacctggcggcagcagtgtcgaacgcgggtggactcggaatcatcggagcggcaagcgcgccgccggaagtggtaagagaacagatccgtgaggtaaaggcgcggacggaccgtccgtttggcgtgaacgtcatgctgctcaatccaaacgcgccggaagtggcgaagattgtcatagaagagaaagtgccggttgtcacaaccggtgcgggaagtccggcaaagttcatggaggcatggaagcaggcgggcgtggtggtcatcccggtcgtggcgagcgttgccatggcgaagatgatggagcgtgctggcgcggacgctgtgattgcagagggaatggagtccggcggacatatcggtgcgcagacgacgatgacgctggtgccgcaggtggcggatgctgtgtcggttccggtcattgcagcgggcggtatcgcggacggaagagggatcgcagcctcctttatgcttggcgcagagggggtacagatgggaacccggtttgtcgtggcgaaggagtctattgtacatgaaaattacaaggaacggatcgtaaaggcgcgcgacattgattccgaggttacaggcatgagcaccggacatccgatccgggttctgcgcaatgcgatgagccgcgaatatttaaaactcgaaaaagagggcgccggatttgaggaactggagcagctgacgcttggctccttgcgaaaggcagtgatggacggggatgtggtgcacggcagcctgatggcaggacagtgcgcgggacttgtgaaaaaagaacagacctgtcaggagatgatagaggaactgatggcgcagaccgcggggcttttaggtgacggagatttttgggaaaagaagagcgtcttcttgggacgcacatcggataagggagaatgacatgggaaagacagcatttttgttcccgggacagggagcacagtacatcggtatgggcagagatttttacgagcagattcccgtgagcagggacgtgtttgcggcggcatccgaggcgtccggtctggatattgcggcgctctgctttgaagaaaatgagaaaataaatatcaccgaatacacacagattggcatgctgaccgtggaggcggcgatccttcaggcgttgcttgcagaaggaagaacaccggatgtggcggcaggattaagtctcggagagtacggggcactgctggcaagcggcgtgatggagcagagggatgcgtttgcgcttgtgagaaagcgcggcatctacatgcaggaggcggtgccggccggcggcgcgatggcggcggtgctgggactggacgcggaaaaaatagaggagatctgcggacagactgcgggcacggtatccattgcgaattacaactgcccgggacagattgtaatcaccggagaggaagcggcagttgcggtggcaggcgaacagtgcaaagagagcggtgcgaagcgtgcggtgccgcttaaggtcagcgggccgtttcactcgcccatgctaaaagaggcgggagagaagctgggagaggcgcttgcggcggtaacactccgggagataaagctgccgtatctggcgaatgtgacggcggactatgtccgggaagcggaggctgtgaagccgctgctgaaacagcaggtgtgtgcaccggtacgctggcagcagtctatggagcgtctgcttgcggatggtgtgaatacgtttgtggagatcggtccaggtcatacactgagcggatttatgaaaaagatcttaaagcagaccgaagtcccggcagataccgtgcaggtatacaatgtggaaactatgggtgacttcaaggaatatatggcaaagtagaggagagagtcagatgctggaaggaaaggtagcgcttgtgaccggagcgggaagagggatcggcagtacgatcgcagaaacacttgcaagggaaggcgcgtttgttgtcgtgaattaccgcggatcgggacaggcggcacaggaactggcggagaaaatcggcggagtcgccatgcagtgcgatgtggcggattttgaagcctgcgaaaacatgatcaaaacgatgatagagacgtatgggcatctcgatattttagtcaacaacgccggaatcacaagggacggtctgctgatgaagatgagcgaggcggattttgaagcggttctttcgacaaatctgaagggaacatttcatacgatacggcacgcgtcccgctattttttaaaacagcgttatggaagaattgtcaatatttcgtccgtgtccggtgtgatggggaatgccgggcaggcaaattacagtgcaagcaaggcgggggtgatcggactgacgaaaagtgtggcaagggaactggcgtcgcgggggatcacctgcaatgcggtggcacccggttttattgagaccgatatgacggatgccatgacagagagcgcaaaggaagccgttcaaaaacagattccactggggagatgcggaaatacaaaggatgtggcagaacttgtgacatttctggcatcagacaaggccgcgtatatcaccggtcaggtgatctctgtggacggcggcatgtgtatgtaagggagtagtaactgaaagaaagtgaggcaggtatgagaagacgggtcgtagtaaccggaatgggcgtgataacgccgatcgggaactctgtagaagaattttggaatgcggtgcgggaagaaaagacaggatttggggaaatcacgcattttgacgcatctggatataaatgccatctggcagcggaagtaaagaattttgacgggaaaaattatatggatcccaaggcggcaaaacgcatggaactgttttgccagtatgcggtggcggcaacgaaagaggccatcgcggatgccggacttgagatggagaaggaagacccgtatctggtgggaacagcgatcggaagcggcgtcggaagtctgcaggcgatcgaacgcgaatataagaagcttctggaaaagggaccgggacgtgtcaatccgcttctggtgccgatgatgatttccaacatggcagcaggcaacgtgtcgatccagtttggcttcaagggaaaaagcatcaacgatgtgacggcttgtgcgaccggcacgaatacgatcggcgaggcgttccggagcatccagtatggggaagcggatgtcatgatcgcaggaggtacggagggcagcatctgtccgatcggaattgccggctttacggcgctgacggcactgtcgtccgagagcgatccgaagcgatgttccctgccgtttgataaggagcggagcgggtttgtcatgggagagggcgcgggaatcgtcgtgctggaggagttagagcatgcgaagcagcgtggagcgaagatttatgcagaggtagccggctacggatgttcctcagatgcctaccatattacatctccggcggaggacggtgcgggcgcggcgcgtgcgatggaaaatgccatgaaggatgcgggggtaaaaccggacgagattccatacatcaatgcacatggaacggcgacacatctgaatgatctgtttgagacgcgcgcaatcaggcttgcgtttggggaacatgccacgaagcttaaaatcaattccacaaaatcgatgatcggacatctgctcggggctgcgggcgccgtggagtttgtaacctgcgtcaaggaaatgcaggaaaattatgtgcacgcgaccgtcggctaccagacaccggatgaggaactggatcttgactactgcagggaggcggtggcgatggaggtgccgtacgcgctcagcaactcccttggattcggcgggcacaatgcgagccttttacttaagagatatggaggcgaggcgtgatggaactggagatcggacagatcatggagatccttccgcacagacagccgtttctgctgatcgatgcggtggaagaactggagcccggaaaacgcgcggtggcgcgaaaatgcgtcagctacaacgaaccttatttcggaggacatttcccgggggaaccggtgatgcccggggtactgattgtcgaggcactggcgcagaccggtgcggtggcaatcttaagtatggaggaaaactgtggaaagaccgcgtattttgcggagattaaccgtgccagatttaagaaaaaagtggtgccgggggatgtgctgaccctgacgacggagatcatccggcagaaaggaccgatcggcatcggcagtgcgacggcgtctgtgcgcggggaggttgtctgcacggcggagcttacgtttgcaatcggcagcaaggaggagtagaggaaaaatggcggctttgtttcagaagcggaaaaaagaaccggcagaaaaaacaccggtggaggcagcacaggcgctgcaggagacgattgtgtgcccggcctgcggcagggagatcaataaaaaggaagcggaaaaaaatctgtatgtctgctatgagtgcggcagttatttcagggtgcgcaccagaaaccgcatccgcatggtggcggatgcgggaacgtttacctcgtggttcgaggatctggcggaggcgaatccgctggagttcccgggatatgaggacaaagtaaaagcggcaaaggaaaagaccggactgcatgaggcggtcaccataggtcactgtaaaatatacggtgaggacacggtgcttggcatctgcgacgccagatttctgatgagcagcatggggcatgtgatgggggagaaaattgcctgtgcggtggaacgcgcgacagaggaaggtctgccggtcatcctgttttgctgctccggtggcgccagaatgcaggaggggatcgtttccctgatgcagatggcaaaaacatctgcggcattgaagcggcattcggaagcggggctattgtatgttccggtgctgacagacccgacgaccgggggcgtgacggcaagttttgccatgcttggagacatcatcctggcggagccgggggcactgatcggttttgcgggaccgcgcgtgattgagcagacgatcggggaaaagctgccggaaggttttcagcgggcacagtttcagctggagcacggatttgttgacaggattgtggagaggaaggagctaaagcttaccctgtaccgcatcttaaagctgcatcacaaaaaagaaggttatgccaatttcgatccggtgcgggaggcagactgcctcgaggcgacagaactgatgaaagagcgcgccacaaaggcgaaagcattgtccgcgtgggagaaggtcaaggcagcgagaaaggtggaccggctggcgtctgtggactacatagagcagatttttgacgaatttatggaattacatggagaccggcagttccgggacgatccggcgattgtcggcggtgtggcgtatctggatggccagccggtcacagtgatcggtgtgcataagggaaaagatttaaaggaatgtatgcaccggaattatggaatgccgtcgccggagggatatcggaaagcactccggctgatgaagcaggcggaaaaatttaagcgtccggtcattacatttgtgaacacctccggcgccttctgcggcatggaggcggaggagcgcggacagggcgaggcgatcgcgagaaacctgtatgagatgtccggcttaaaggttccggttctttgcattatgatcggggaaggcggaagcggcggtgcgctggcactctctgttggaaatgaggtctggatgcttgagaatgcgacctacagcattttatcgccggaagggtttgcatcgattctctggaaggatggcagacgggcaaaagaagcgagtggcgtcatgaaaattaccgcgcaggatttaaaagcgctcggcgtgattgaggagatcataccggagtacggcatggcggatcagccggcactgatttccatatcgcgttacatgaagaggcatataaaaacatttttgaaaaaacagaacggaaaaaccggggatcagctcgctgcggagcgctatcagagattccgcgtgttttaaaaggaaggagacccgatatgaaggtaaagatcgtgggcaccggaagtgcagtccccgaaaaatgtgtgacgaacgatgatcttagtcaatggatggatacatcggatgagtggatcagaagccggacgggaattgagaccagacatctggctgtgagagagacaacgacagaaatggcagtggaggcggcgaagcgggcacttgcatctgcacatatggacgcggaggagctggagctgatcattgcggcgacgatcacgccggaccggctgctcccgaaccttgcctgcgaggtgcagagcgcactcggggcatgccgggcggtcgcctttgacgtcagtgccgcctgctcgggttttttatacgcgatggatattgcacgccactatctggaagccggcggaagccggcgggcgctggtaattggtgcggagacattgtcgcggatcatggactggagcgaccggagtacctgtgtgttgtttggggatggcgcaggtgcggcagtgctggaagcagatgaggcggaggagcatgcgggcatcttaagcaccgtgcttggaacggacggcgcgggcgggatggtattgcgctgtgacaaccgcagaaatcacaatccgtatgtgaagggcgacaccgcgctctcgtacgtgtccatgaacgggcaggaggtctataagtttgcggtgcgcacggtgccgaaagtaattgccggggcggtggaagaggcagggctttcgatggatgaaatcgattttttcctgctgcatcaggcgaaccttagaatcatcgaggcagtggcgaaacgcctgcatcagccgatggaaaaatttcccacaaatctgcagaagtatggaaatatttcctcggcgagcgtgccgattttacttgataatgtcaataatcatggtatgataggagaaggcagtaaaatagtactggcaggctttggagccggtcttacgtggggcgcagcagtgctccgctggcaggcggtgtaggcggtgtggtcgggaacagatactgctatgaacaggagtatgatacatgaccacggatgagacattgaacgaattactggtaaggctattcaaggatattatggagattgaggcgagatgtctggtgaatgaggaatttaaggacatcagctacaacgattttcatattatagaagccatcggattaaaggagccgaaaagcatgacggcggtggcaaagctgatggatgtcacgaccggtacgctgacgaaggcgatggatggcctgactgagaaggggtatgccgtaagagaacgcagcaagcaggacaaacgcgtggtgtgggtgtacttgacggacaaaggaaaagcggcatatgcgcatcacgaagagtttcaccgcaaaatgatcgccaacatcaagggacagctgaatgagcaggagacgccgattttgatctatacgctggcaaagctcgtggactattttcaagaggaatatggattggaggaggaatagacatatgagcagaggagcgttgggcaagaataactgggcgctgtttttaatgcttctggcaggaattatgctgggcggttttatcggaaatgctgctgcaggtgtttcgggacttagctggctgaattatgggcagagcttcggcttcgccagcccgattgtgctggatctgggcattctggtgatcacattcggattatcaatcaagattaccatcgccagcattatcggcgtgctgattgcgattattatttatcgcttgatttaagagatttgaaattaggaaagaatagccaaacgcctccggcaggagagagtcttctgccggaggcgttttttccggttttgctatcctgctataaagctttaacaatttagcggaataaagaaaaaaagattgcacatgaaaacattttatactaaaatgtatctgatgaaaatattgcagtgtatacacagcacaatatactaagagtaaggagacaaaaaaatgggatatgtagatgaagttcttgcaaaagtaaaagagaaaaatgcttccgagccagagttccttcaggcagttgaagaggtgctggagtctttaagaccggtgattgaggcaaatgaggaactgtataaaaagaatgcgattttagagcgcattacagagccggatcgtcaggtaatgttccgtgttccgtgggtagatgacaatggacaggttcaggtaaacagaggtttccgtgtacagttcaacaatgccattggaccatacaagggaggattaagacttcatccttctgtaaacttaagtatcatcaaattcttgggatttgagcaggtatttaagaattcacttacaacacttccgatcggcggcggcaagggtggttccgattttgacccgaagggcaagtctgacagagagatcatggcattctgccagagcttcatgacagagctttacaaatatatcggtgcagataccgacgtacctgccggagatatcggaacaggtgcaagagagatcggtttcttattcggccagtacaagagaatccgcggattatacgagggagttctcacgggtaagggacttacatacggcggttctctcgcacgtacacaggcaaccggatatggtctgttatacctgaccaacgcattgctgaaggatcacggcatcgacattgcaggcaagacctgtgcagtttccggttccggtaatgttgcaatctatgcgattgaaaaagcacatcagttaggagcaaaggttgtgacctgctctgactctaccgggtggatctatgatccggaaggaatcgatgttgcattattaaaagaagtaaaagaggtaaaacgtgcgcgtcttaccgagtacgcggcagcaagaccttctgcagaatatcatgcaaagcagaatggtgagcacggtgtatggcagtacaaggtagatctggcacttccgtgtgcaacacagaacgagctcgacatcgaggatgcgaagatgctggttgcaaacggcgttacatctgttacagagggtgcgaacatgcctaccacactggaagcgaccaaatatcttcaggcaaacggcgtattattcgtaggcggtaaagctgccaatgccggtggtgttgctacttctgcactggagatgagccagaactccgagagactttcctggacattcgaggaagtggatggaaagctcaagggcatcatggagaccatctacgcaaacatttcagatgctgcaaagagatacaatgcaaccgttggcggacagacagactacgttgcaggtgcaaatattgccggatttgagaaggtagtagatgctatgttagctcagggtgtttgctaattaagaaattctaagataatataagatatggttaagtcctgtaaacccagtgtttatgggacttttctttatgtattgaaatgacaaaagaattgtcagaatattcataaatagaagataatatacgttattttgaggtcgttatatacacgtggtacacaagtgatatacatgtggtatacacttgtttttactgattttggatgctttttaaagcgtttccatctgttacttttcaggatgattcaggctgaacatgagtgtaatgttgataccacaacaacattataagtgtattcagtttttgctcctaaatcttgtttacttctgtaagaagttcttctaaagtcttatgggtgtacgttcccttggtggtgtcgttcttcatactgtgtcccataattaatttgatacatacgtcatttgccccggcgctgtccataagtgaagcaaaggtgtgtctgccatcgtggggcagatgtttcattttgagttttcccatgcacgtattaaaattcccgttcatataggttccgtaggtgtaatgatttccaaacttgttattgatcaggtatttcttgttcggatcgtagcggttcttgacgagaggaataatcttatcgtttagtgggataattctgtctttcccggcttcggttttcatgccgccaaccatgtacttttcatctaaatggacattttccgtctggatttccaacagctcggttggtcgcaagccggtgtaaatcattataaggatgatatctacattgttgatttcatatagcttcgaccagagtgttttgatttcttcatcggaatacctgtcgtgtatctgctccgtagagtttgtccattcataaaccagaccttctgttaaatcccggtctatgtattcattcaatttagcgtattgatacatagccttcaggacggctcgcatagaagaaatcgtagtctgcgacttgtgattataggcatttaagcattgctgcagatcatttgtcctgatggaaataaatttgcggtcatgcagttcactgaaatgatgaaaagcaatctcataatttcgccacgtggaatcactaatctggtttttaagagattttcggtatttcttccatttctcgtacatctctgcaaaggtgggagagtccgagtatttcatatgttccggaacaaccgcaccgctattgtattcagctagataggtataagccatttccggtttggagaagtaagctaggtaggtgtattttcgcttgaccttcccggtatcgtcttccacaagtttcgagatacggacagcgtagggctttcgtcgtttgccaccaagcttgattacgctgccgtaagagtttggtaacttcatactttaaccttctttctgcatttgttctaattgtttaaggcaatactctgcatattccttgtagcgttttactcttgcaatttcatttggaatatcaaaagcataaatggacttcggaagcaggtcagaacgtttggtaggattagccactttgtacgcagagagcttatactcaacaaaatctttcacttctttttccagttctgccagcttggttaatggtatctgggcaacgtcttttccagactcatttgaatagacatggattacgccatcttcagcaatttcttttacatcaacagatccggttgcagtatcgaaggaatcctgtaaatgggcttcctgaagaagctcatattcaatcgtatagccgatatcatgcaggtaggagagaacaccgtaataaggctgttcatattcatcaatgtagtatttgcgtatttcaaaggaattgaaatagtcatcgatgattgcattaacaaaatcattggtgcactcgcagtattgcatcaaatctccattttcattaggaataaacgcttccataggtattttgtaaccgctggctagcactttgagaaaactctctgttacaggtttcttaccattctctacgttgcagtaatgcgttctggaaattccaaagtcttttgctaactggttctgtgataaccccctttcttttcgtatttgaatgatccgtccccggatttcatcttgatttttcagcatttttcatgtactcctttcatttacacatcatatttgctcgtaccatatgagaaacaggattgcttgcatgtactatatagtacataattagtatagacaacaacagcaacaatgtcaacaaaaatatggaggagaaacaagtgaaaaaagaagaagtaaaactgctgatgaagcaaaatcaggtaaagcagtgggaagttgcggaagcaatgggaatttccgaatttacgctttgcagatggctaaggaaggatttaaaagggaaacagcttgaacggctgaattcggcaattaagaaggtcagaagcggtaaagaggagacaaatggaaaggaggggcactaatggaacgagttacgacaaaagaggctgcaaaattgcttaacatggatgttgtgactttacagtttttgatgaggcaggagcggctgccgattggatatgccatcaagaaggatggaaagagccgctatcattacatcatttacagaagtatgctggatgcgtttatccagagtggagggaaatgctaaatggcagggaaacgatattactggttgaaattgcaggtcggtttctttcaggaactgattatcaaacaactgcaaactttgccggagggagacagtatcgtcctgctttatttgaaactgttattgaaggcaatcaatacggaagggattatttactatcaaaatattttgccatccttagatgaggaaatagcattggatacgggagagaaaccggcacttgtgaagctgacgatttctgccttgtgtaaatatcatgcggctgtgttcttggatgatcaatcattacagttattgtacttgggggacatggttggaagtgagagtgcttcagcatccagagtcagaaatcacagggcgaatcaaaagctcataaaggaaaaagagcaggcagcgttacaatgtaatgaaactgtaacggaaggtaacaccatagaattttcttgtagcacagagatagaaaatagtcagaaggaagagaaaaagccaaaggaagagggagaaccagagatagaggaaattccttcttactttgctgatacagtgctgaatagtatgtttctttcttacctggaataccgaaaagaaaatggcaaggaagtgaaggggaaagcaatcggttattgcattgataagctggaaagtctatcgaattctccagcagaacaagtggcaattattaagcagacaattcagaatggatggacggatttctttccgttgaaagggaaaaaggaaaaggtaagcggaagcaatgtaagctcatggttggagcgtgaaaagatacaaagtacgggaggtgctttcggtgactaaacaggaatttgcgacattagttgtagccatgcaggcaatgtatggagaagattttattgggacggaaaaagcgttggatgtgtggtacgctttattgcatgatctggactatcagattttatccaaggctcttcaacaatatatgctgacaaataaattcaagccaaccgttgcagagttacgagagatatatgcagagttggttagcccggtgattactgattggagtgaaggctggaagaaagtcagcagggcaatcgggcactatggaatgtatcaggagaaagttgcaatggaaagctttgatgaagttaccagagaagttgttaagcgtctggggtttcagaatatctgcctgtcagaaaatattgttgctgaccgggcaagatttgcagaaatctaccaagccatccaaaggcggaaaataacagaagtgaacgtaggaagtgcattgccgaacttacgagaaatggtgcagaatcgcttggctgaactggtacagaaagggcaaaattcaatagaacaggaaaaggataaaaactaacttagcaagcactgcctgtgttccctcacaggcgataaaatgagcgatttctcttatcgaaggaatgctcaaatttatcattcagggagaattccctaacccttaaaatcatttgaaaggatggaacgatatggcaaaggatagagcaaacagaacgaggaaaaatgagctgaagatttatttgagtgataacgaaaaatatatcctggacaggaaggtggagttgtcaaagaggaagagtgcatcggattatattaggacactgatactctttggatttgtttatgatgtggattattcttatctaaggcaatacaacgaaacgcttggaaaaatcagtgggaatctgaatcagattgcgaagagaattaacagcactggaaacgtttataaagaggatatggcagaagtgaaagtaattatggacgaggtgtggaagacgcagaaggcgatgttgaaaaaacagccgttgatacataataaataactcaaaaataataaggaaagaaattgaaggtatataattgtaaccaatgtaagaaaggtgccttgaggtataagcgatagattgatgacagactgtatggtataatttgtaagttgattctattatgtaagccgtaatcacagctattgcaacttaaaattgcttagttgcaactgtattttgatagtcttcacaagataaaaatggtacgctgagtgagaaaggagtagtgatatatgacattaggacaaagaatacaaaaaggaagaaaagaggctggcctatctcaagaggaattggcagagcagttaggtgtatcaaggcaggctgttagccgatgggagaatgataatggttatccagagatggaaaaaatcatacgtttaagtcagatttatcaagtgagcttagactatttagttggaaacgaacaagaaaaatcgggagaggatatatcagaaaaaggttggtatgtcagtaatgagttggcagaaagctttctggcacatcaaaaatcaaagtttatgaaaataggtatttgttttctactggcgtgtgtgtctagtgtgttttcttatatgaatatgtataacaacgttggtgatgtgattagtacgtttatcataatagttgctattattttgataatcagtatggttatatcagacaatccatataaaaagatttggacagaaccattggtttttgatgccgaagtgttgaaacgattaagagtgacatttgcggaaaataagaaaaagtataagataatgatattagggggcgcatttgtatttttaataggatttctgtttttaccagatttctattggactgttccagaagatttgcagtatatatggtatgcgttaggagatgcagtacagggaataggtggatgctttgcaatttatacatgggggatatggcgagcatataggctattaacaatgaatgaagagtattggaggaggaagaagaaaaaatgataaaaaggacatatttattaacaatattattaatagtttgtctgttgacaggttgtgggaacaaaacagaaaagatgtgccgtatcgaaatacgaaatgagaataacacagatgttataacattagaacaacagtctcaagctgatgtagatgatttttttgatgaggatgaatggaccgaatgcgagaactttgatgaaaaactggcttctgaatatgtaatagagctgtatcaagaaaagacacatactagagtgcaacctgataaagaaaatgcttatgagaaaatcatggaatataccacatataaggattcagatattgttaaggtagttattagcaaagatgccataaaaagtggtggtgtgtcagaagaagatttaaccttttactataaaggttcagagcattttttttcggcactcaataatgttttgaagtgatttctgaacttaaaattggatgaaccaatgggaatggaagcctattttgttataagggggtgagtatatgggaaaatgatgatactgacatttgaagatagtgaggaggaaattctaaatcatataatatcctgtgtcagtgcgggatcaagagcatatcaagtagttgaaaatgaaaaaaagaatttgagttttaatggattagaaatagatgatataaatcgttcggtaagaaaacagaaacaggaaatagatttgacatttacagagtttgaaatcctctatctgttagccaacaatccaggcagagtgttcagcaaggagcagatttatgatattgtctggaaggaatcttattccggcgattataacattgtcatgagccatatacgcaacatacgggaaaagatagaggataatcccagcaagcctgtttatgtacagacagtctggggtgttggctatcggttcaatcagaaaatgttataaaatatagccacattgatttcaacataaatcatgtggctattttcgtgaaaaatgtttttagagtaataaaagagatgacaaaaaataggcaaaatgtatagaaaaagagagggtagtgtgttatagtaaatatactgggtggactttatgtataacatattcgaaggtggtttatacaatggcaggtatatcaaaagtactggaaacagaattgaacggtttgaaggttaatctttttgaatttgatattgaaaatgaagaaagcttcaatgagataaaagcatatttagttaataaagtaaaaatatctaaagtacataatatagaagaatatgatttgacgtattatggaacaaaaaatttgaatccagattttgtggccagatttaatgagcaggttgcaaaaatcaatattcctaaaaaaacgaaaataccacaatttgatgttcgcagagaacgcgtaacagaatggatggcacagtatttgctagaacaagaatatggttgtaagttttatgatgaagctgataaaagagtaaatttgaaaaccgttgaaattgataaacatactgacgggatagatgtacctggtatttggatggataatgatagaattcgatttgttgtatgtgaggtcaaggcatctgaaacaaatcaaataccatgtgattctgtgcaatctttacgacaggatattcagaaagctattgatgatgtagacaatcgagtttctcacgaaattttggaatatatgcatggtataagaaatgttaaaatgcaggatgatatattagaaaaaatagtagactttttagcgaatttaattgctggagaaaaggaagacttagcagataatataatgtttttcccatttttgcttagaaataacgagaaaattgttccggagatgaacatagacgattataaaaatttttctttacagggagttaaaagagaaaatgtcgagaatataatcttatcatttagaaagaaattttctgaatttagtaatgaagtctatgaagaggcaataggtgaatagcaatggaatatattaagagcataattaattcaatagagaaagtatttgatgtaagcgaagaaaatatttcttcgcttactgttatgctcgcagatattgaaactagtcatttatataataagttttctgcaaaagaacaaagtaagaaatatttgaatagtgatttactttctaaggcgaatttgctgaatgcattattggaaattgttttagaaaatccaaatatggatttaattgagagcgacaaacgaaaagagttacttgtaggtttatgtggaacagtagcatccctgtatgagcaagttttagatcagattaatgataatgagtgttgggaaaatatgtcgtacttggttatgtatagtatgttatcttatatggcagatagacagacaatgtctgatttggctattaaggaatataatgttaaatttaccaaaatgatgagtttatacaatgaatttccaacgatgcagaaattagaatatgatacatattatctaattgtattgttgatgagtaatattaaaaattatgatggattgacacagttaaattcctatattaaaagagcaaatgataatttgaatgaggctcaaagggaggaactttcaaaagctgagttagatataccggttggtctaaagattgcttcttatggaaatattatttatttgacgatggttttaaaagaatatctttttagcggtgagattgatagttcggaaaatcaagatatatatagtgttatcgatatgtattcatataatgcatttcatttgctggataatgaaagcattgacttgaaacttattgggcatttgttgcgatatgcatatgaaagagtagcggaaaattcaatatggaacattgcagaaaagtcaccattaataagaaagttcatcgaagaaaacctttccaatggtaatagatacatatattctttattgccatctcagagagaggttatttcggatgtgttaacgcctaaaaagagtattgttgttggaatgccgactagtgcaggaaagtcgttgctggcagagatgcagatattatttagtattcataactataaaacagccgattttaatcctacagtttgttatattgttccaactaatgcacttattgatcaagttaaaattgatttgcaaagtgattttaaggaatttaattttaatatagaaacagcattaccatattatgatgttgatgagatagaaaatgaaattttgacgcgggagcatattgatatattaattagtacacccgaaaaattagaggcacttgtaagacaaaaccatccggcaatacaaaacactcgtttagttattatggatgaagcgcacaatttaggagacaaatcacggggttctaaatttgaactggtcttatcatctataaagcaaaatatgaaagaggcaaattttcttttattaagcccctttattagtaatgctcaggaaattagcgagtggttagccgactcaccaagaaatgcagatactatttccatagagtgggcaccaaccaaacaatatattggttgtaatttacttgatagtaagaaaacaaaatctgttctgcaattttacaaatcaccaagaaaccaattggggacagaaaatgttgaaatttccttgaacttgaacccgcaggatgtgaaagaagagcttagattagatagtattgataatacggttcgactttgtgtggttctgaatgattttattgaacaggaagggaatattttagttttgtgtggtggcagaggtaccactttgaaattggcatcttatacgaaaatgtattttgaagaaaaaggtatgctgcctgatatgagctgtgacgaagaaattcaacgtgcaatagagattgtaaagttagaaaatggagaaaatgatcctttaatcgaatgtttgaaatttggtatttgttatcataattctggcttatcaagtctggtcaaggaaactatcgaggaattagtccgaaacaataagataaaacttatatttgcaacaacaacattggcgcaaggaatgaatttcccgattaatacggttatttttgatacagttaaattgcgtaataaaggtgatttatcaaacgctgagttttggaatatagcagggcgtgctggtagagcatacaaggataaagagggatatattattctctcctattctaattcccagaaagaaaccaagtcaacagtgaaaagatatattgaatcagatttaaaagaagtaatatcttcactgaatgcttattttacgggaaatagtactataagtattgactacaatgtgttaaaagaaccaaataatgcaccaatattaaatctgttgcaatatataaatcatatattgaacattagctatgattatgatattagtccaaaagatattgctaaaattaggggaatattaacagattcttatttgtatcatagtttgagtaaacaggaaggttttattaatgcacaaagaaaattaaatacttttgtaacacaatatattcgacatgttaacgaaaataaaaaggaggatatggcgaaggctgatgaattaggtattagtgatataagttatacaaaggttaaatctataataggtgcatttatccatggactgaaagaaaacggagatcatgagtataaggcttcagaaattattcttcgaactaagaatattgagcgtttgacagagattattaatattattgcaaaaattcctgaaataaaaattgatatgttagggcaagggaagctggatccagaaaatatagctaagttacttatgggctgggtaaatggcgataaggtaagagatattgcgaaagaaattaaaagaccagggcaaagcgatgaagatgcaatttctttatgcaatcgttatcttaatagccagatgaagtcttatatgccatggggaataaatatatatcaggccgtgagctttgatttgcagacagaaaatgcacaaatgttaccttcttatatttattatggggtatcaagcaaggaagcggtaattgtatcgaagttgggcgtgccaagatttgctgttgataatgttttaaatattttaaaaacagaatattccagtgtggatataagtgtagctaattataaagaagtaaaagcggttatagagaaaatttcttcacaacaattaaaaattgaaaatgtaagtggcgaaattataaaaaatattattaaaaatcggatgaaatagtgtgatatgtaaaaactttgagataaggagaaaaaaatggctaaagttataacatttataaatatgaaaggtggggttggtaaaacaacgcttgcagtaaatgttgcatatacattatcaaaaattgagggtaggaaagtattacttatcgatatggatccacagatgaatgcaactcagtacacattaaaagaagaacaaatgcaagaaattttggaagatagaaataaatcagtttatggctgcctgtctccagattatcaagcaaattcagtattggaaggctatacaaaacttagtgaagaaaaatggatatttcatgtagatggttttgatattattccatcaagtttggatattatgacattgaatttatcggcaaggccgcataaattggatcagtatattaaaggtgaattgggagaaaaatatgatgtagtaattattgattgtccgccaactatatcggaatataccaaggtggcgctgcttgcatctgatatgtatttggttcctatgaaggcagatccattgtcagtgtttggtcttcctatgttagagaattatgtgaaagaaactattgaaaaggattttcaacatcaaatagaatttgtcggaatagtattaaatatggttattccagagagattgttatacaagaaaaataagccgataattcaaagaagatggaaaaataagttgtttcaaaatgaattaaagcaatgcgaagaaattgtgaaagggcttgatcctgaattgtctaatgaaaaatatatattggatatgagagatcctataattgttgatcaaataaaaaatataacaaagcaactaattcagagaggaaggttgtaattatgaaaaaagaaaccaaggatgcgttatattcattgttggatttgatggatatgttaggaagcattgattttattaaagtagatatagatagagctaatcgcattagaaaagaggttttggatgttattggtgataaaaaggaagtaacaattcttgatagtagtacagacgagctgttaggtgttttgccggttattttattagatagtaaaaaattcccgtctacaaaagaaattttgaagtttgccgaaaagtgtttgaatataaaaattaagaattattggcaaaaacgttctagggcagaagtggtagggataattattaacgaggtttatgagcagagcccagaacaatttaataattttttaaaggcatggaatgagtttagcaatgagacgaatcatcaaaatatgaatgcgaaacagaatgtagaaaatataggttttatggatgcgtggtttcagttctttgatagttataaaggtgttgaatgatggaaacatatggttatgagttagaagaagaatttaatgctgtagctcattttattaaccaaaaatatgggattaatataaaaacaaaagaacagtcagtagattttacaaaagcttcattaacatttatgttgtcggtaaagatatggaagaatcatttgtctccgtattttgaggtgacccccaaaacggaaatgtattttcaagagatattatctaatgctattcatataatattactaggaaatattgacatgaaaattccaacattgattatgttaagaagaacacaagaattgatattaacatatatttattatagtgaacatccagtagaattatataaaaaagaaatggatgataattcaagaacaatagggggattcaatgatttaaaagagtatgttaagaactatccattctcaatgaaatacaatcttgaagacaagaaacttcaagagctgatgtcaatggtaattggaaattggacaacgcagtatagggaattgtctaattatgttcatggaactaatagtaattttttccaaaagacacagtatgttgatgaatttaagtttgtgaaaaaagatataaattttttgactaaacaggtcagtatgttatctagcacggtaaatgttttgttaataattttttattttaaagaatatgtatactttgacgaacatacagaaaagtcattaatccgaaatgcaatatcaaacgaactggaatataaacgaaaaatagtagaaattttaaaagaaatataaaatgagtattccgttcaaaatgagcactactcatacggaatactcaaaaacaagaaaacagtataggtactaaagaatttctaattaaaagtatattttgagagaatgaaagatagatgataaagaattcgatactaaagtatagttaattctgtgttcttcgataattgttttaataattcatgtcctttcccaaataggtgttaatcgaaattctccgacaatcactctatacacgtgatatacaaacgacctcaaaaccccggtaaatctgcggacacctcagaagctgctatgctcgctcagggtgtttgctaatcgagaatttctaagataatataagatatggttaagtcctgtaaacaaatcaaatcttcgatttgactggtgtttatgggacttttctttatgcatatataagacatgtgaatggtgagaatattgataaatggaagggatgttattaaaaaaatttgaagctgtagaattttacgttgaattttacagcttaatttcgtataatatatgtaaataaagaaaagatatccaggaaaggaagttgattttatgccgaatatattacctgtatcagacttaagaaattataatgaagtgttgaaaaattgccaggttggagagccagtgttcctgacaaaaaatggcagaggcaagtttgtaattatggatattgaggactatgagcgtgagaaggcagagaaaaagctgttgatgaagctacaggaagcagaagaagcagttaaggatgaaagcgcctggatgagtttggatgaactgaagaaatctgtcggggtatagcctatgatgaaattacggattaattctattgtggcagaggacttgaagaaaatgaaagagtatattgcggaagacaatgaagaaatggcagtaaagaccattcaggagatatatgctcgaattgagaatatacagcaacttccgtatatgggatcggagcttgctaaaagggtcagcttccggacggattataaatatgtgatttgtgggaattatgttgtgctgtataagattggaaaagagtatgtggagatttaccgggtggtgaatcggcatcaggacattacgaagatattttaaattaaacggaagaaaatgatggaataacaagtaaaaataaaaataaaaataaaaatgcctaccttcgtacctgactggtggaaggtaggcatttaattaccatagtaattatgcgtaatatacaaaacgctatgaaagctttatttttaggtggttcttctatccttacaccatctctttttccccgatcttatttacgatcgtcctaaaaatccggaacatgaagaggatcgtcatgataatggagatcagctctgcgatcgggaacgcccaccagatcaggttgacattgccgaactgcgccagaaagtaagcaaccggcagcagtgcaaccagctgtcttgcgatcgagacaaacatactgtagactgctttgccgagcgcctggaaaatgctgctgcaggagatgccgaatcctgcaaggataaagcttaagctgataatccggagcgccgggacgccgagagaaagcatggtgtcggaagcgctgaacattttaagcagctgcgttgggaagagctggaagatcagaagtccgaccgccatgatgcagacggcataggtgaccgtgtggcgtaaggtcttgaccacgcgctcgcggctgccggcgccgtagttgtatgccatgaccgggatgacaccgttgttcagaccaaacgcaggcataaacacgaagctctgtaatttaaagtaaacgccgaacactgccgttgccgtggaggagaaactgatcagaatacggttcataccgtaattcatgaccgaaccgatcgcctgcatgacaatggaaggcacgccgatggcatagatctgaccgatgatggtgccgtccgggcgaaagccttttaaactcagctgaatctccttatttctggtctggttgatgacgacagcgagaaccgcagcaatcatctgaccgatgacggtggcggctgcagcaccggtgatgcccattttcggaaaaccaaacagaccaaagatcaggatcggatctaagatgatgttgatgaccgctccagtggtctgggtaatcatggtgtagacggtttttccggttgcctgcagcatacgctcgaacatcagctgggtaaagcagccaaaggacaggcagcagcatacagtaagatactgctttccgtagagaacaatttcttcaatatccgtctggctgcggaaaaaaggttccgcgaaaaacagaccgatgataaggaacagcagatagctgagcaataccagaaaaacagcgttttccgcaatcttgttgactttgtcgaaatccctctctccgagtgagcgggcgaggagcgcattgacgccgaccgcagtacctacacctacggcaatcatcagattctggatcgggaaagccatagatacggcagtgagtgcgttttcactgatctgagccacgaaaatactgtccacgatgttatagagagcctgtaccagcatggagatcatgattggcagagacatggatatgatcaatttatcgataggcattgtgcccattttattttcctgcatgggaaacctcctttgttgaatggtataacgttaaaacgacctttctatactaccattttgcggtagcgattacaaggcatggtgcaaggattggggaatcttttgtgaaacggtggcactgtgccgcaatttttggtaaaatagatgagaaaaaaagaacaacaggagattatacagatcatgaatatattattttttctgaccccgaaggaagatgtggcgcatgtagatgaggacgataccatgcgtcaggttctggagaagatggagcatcacggctatacggcaatcccgctgcttagccgcgagggaaaatatatcggaacgatcacggagggtgatttgctctggtttttaaaggaccgcaattttccggatttgaagttgcttgaggatatgccgatcacctccatccagcgccgcagggacaatgaggcagtcaagattgacgagtcgatggaagacctcttcggcaaggtgatgaaccagaacttcgttcccgtcgtggacgacaagcgtgtgtttatcggtattgtgacgagaaaagatattctggcataccttgggaagaaggccgccgcgcaggagaatggcgtgcggggcatggatcaggcatagtgatggtaagccatacgggttatgtgacagcgctttctgtcagaattatcagcaaataagtgagacagaacaaaagaatttcttaaatttgttatttttttcacaaaacagaatggtaatccgctataatatgaaggagagacaaggcataacatttatacaaaagaaaggggaatttacaaatgaattcaattttatcagcgacagtattgattccactgattgtgatcgtgctgctcatcgtactgctgtgcgtcggatacgtgaaagcaccaccggatatggcgtacattatttccggtgtcaagaagaagtccaaggtggtcatcggaaaagcgagcatccgcattccgttttttgagcgtctggataagctgaacctgcggctgattccgatcgacgtcaagacgagcaatgccgtgccgacagcggattacatcaatatcaatgtcgatgcgaccgtcaacatcaagatcagcaacgatccggagaagctgcggcttgcggcagagaacttcttaaataaaaacaccgagtatattgccggggtggcaagagaggttctcgagggtaatgtgcgtgagatcgtcggtaagatgaagctcgaggagatggtatccgaccgccagaagtttgccaacctggtcaaggaaaatgcggagccggatcttgcggcgatgggactcgacatcatcagctttaatgtccagaatttcgtggacggcaatgaggtcattgaaaatctgggtattgacaacattgtaaagatcaagaagagtgcggcgattgcccgtgccgagagtgagagagacatcaaggttgcacaggcagcggcagacaaagagtccaatgatgcagcggttgcggcgcagacggagatcgcgaagaagcagaatgagcttgccatcaagaagtccgaacttcagatggaggcggacacgaagaaggctatggccgatgcggcttacgagatccagaaagaggagcagcgtaagacgatcgaggtgacaaccgccaacgcggatattgcaaagcaggagcgtgagattgagctgaagcagaaagaggttgcagtcaaggagcagtctctggaggcggagatcaagaaacaggcggaagcggataagtatgcggcgcagcagcgcgcggaagcagaactttaccagcgtcagaaggacgcggaggcgagacagttcgaggcacagcgcgaggcggaggcgagaaaagcgcaggcagaggcagagcgttacgccaaggaacaggaggctgccggtatccgtgcggtcggtgaggcagaggcatctgcgatccaggccaaaggtattgcagaggcggaagcgatggagaagaaagcggaggcgtacgcaaagtacaataaagcggcagtggcagagatgatgatcaaggtacttccggacattgcagccaaagtggcagagccgctcggccagatcgacaagatcacgattatcggcggcggagaaggtggaaacggtgtggatcaggttgccggcaatgtgccggttgtcatggcaaaagtatttgagagcatgaaagaggcgaccggtattgatctggcagacatcatcaacgcagagtcctacgatgcacaggtgaaccgcaacatcaatgtgtcgggactcgattccgtgaatcttgtggtaaaagatgaaaagaaaggcgcagaacagccggatgcgcaggacggggcaacgacagagtgatgacggtggaagttggcgtcaaccgcagagcgggaacggggcagtctgttacggcggcagtttttatcgtgatagcggcgggatcgatagcggtgatcccgctgcttgccgcaaaccttgaccgtagagcactcgggcttgcggcgtgtgttctcacattagttttctgggtcgggtttatcggggcaatctgctgcgtgggggagattgtaaatacgccgaccagggcgttccttctcaccagtgactggcagttgtattatgttcattttgcagcccgcgactacggacccgcaccggtgacaaaagccggggagatcgtacataattacaaggtgctctccgaggagaaaaaaggacggaaatggcgccgggagtatctgggcagcgaggagttccgcagcatggcgcagcagtacctcgagggagtgcggacggatacgatggggtgcgtgatcgagcatcttcagacgccctctatccgttccgaaggcatcgacggaagtgtgctgcgctactgggatgacacccggaaaaagtgggcaacgatccggcttttaagaacaaataccggatatgagaaaatctgccgtacggtaaagctccgccaggagctcggacgctaagaacatctataaaaacgggactgccgcataaagcggacagtcccgtttgacgtgataagtaatataaggaggaagatcatcctatcgatttcagatggaaatgtagatggaacattcgttgaaaaaaatgcgcgcatttcttcctgccggatttttgcatcgaattccgtgtctcttccacgttttgacaatccacggaatgtgtccgacaaaccgcagacaatgagcggattccctagtgtccctagcggcactgcttcacagacaatataaaaccgcgcgaaccgaactcgccgtcatctgctattgaagttaaggcagatgacggctcaaacagcggcttcgcgcggttatgttttattcagcagtgccacaagggacacacgagaatcctaaaattgtctgcgggttgcggacacgcccgtggagtgttcaaaacttggaaaaacacggatcatcggagatgcaaaaaccggctggttagaaatgccacatttttgatccgaatttccagatgcattccatctgaaatcgaaggacatggtcattcttcatactacttaccacatcaaacaggactggctgtttgatgcgacagtcccgttttgtatggaagagaaaagattactgtgtatttttctgcagttcattggcattttcctgaagctgctgcatgatcagggcaatgtcgtccacgctttgcagattggtgcggcagccggcaagggtcgcaccagcgcttgcggtaacttcctgtgtcagggcggatacattttcgatgctctggataatctggctgttggaatcagataccgcatccacaccctgctttaactcggacatgccggaggtaatgcttgcggtatttttctcaatgagatcaaaatatccggcagcagaagtaatgtattcactctggtgcctgttgctgtcgaacagttcagtgacggagtcggtaacggaggaaatggactgcgagatgtgctcaatcaactgattgatatctcccgtagcaccattggtctgaccggcaaggctggaaatctcctcggcgacaacggcaaaaccgcgtccggcttcaccggcgcgtgctgcctcaatgctggcattgagcgctaaaaggcttgtctgggaagcaacactgctgattaaggcaacgatgctctgcattttgtcagcatattccttcagctcttccatagaatccgcgacgcgtgtactggaagcctctgagacctgtacctgctgcacaagattcttcataacatctttgcttgccgtcagattggcagaggtctctgcggtggaggagagaagttcggcagtgacggatgatacgttctgtacctgctggtcaatgttttctgtctgctgttgctgcacctggatggcagcggcggtctcggaagtgccgctggtaagatcctccatggcggtctgcgtgccggcgatggaatctcgaagctgtgaggtgctgtgtgaaacctgatcgatatttcctgccatatctccggcaacctttaaggtcagctgcagaagatcatcggactggctgcggtcagagtcagcctttttgatgttggcatcgttgatctgcgcaatctttgtgacagacatcaatacaaaaatataggaaaggataatgcaggcgattataatctcggcattggtaatctgggcagcggtgaaaccctgtgtaacggcacgaaagaccagaacaaggatattgatcaccagtgcataagtacacagcagggaaacgagctttttatctgcatacaccagaagaatcaacagcattacgattacatagcagaacgtcagatctgttgatgagataaacatcacataggcatacagaagggcaaagccgccgccgcagagatagcgcacactagaggtatccttctgctttgtgtaggcaagaatggatgtgacacagggcagcagacagagcagaagaaaaatcagatacgacggaagactgcgcacgccttttaagacttctgcgatgtaggccgccgcaagtaccgtattcattgtgcaggtgccggcaatggctgtcttattgcggctttgtgctgcaactgccggatgggaaagatcggtcaaacgattatccatagaaagaatcctcctttgtaaataccgtattactctaaatgtaaaaaaggcaccggtgcatcttgtgcaccgatgcctttttcctgttattattgtaacagtttggcggatgttcataaagtagatgtaagaggaacaggactattttaccagattttctgcataatccagagcttctacgatatttgcatggaaattttgggctccgacgtactcggtaaagccatctttgaccattacggacatcggctgttcgttgacgtgggagaaaaccagtgtaatctttttcttttttgcacggtcggccagttcgcgcagtgatttcatggcactggcgtcgatggcagggacgctgcgcatgcggatgacaatcacgcgggtagccttgtcactgttgatctgtaagatctggtctgcggcggcgaaaaacagcggaccactgatctcgaagacacggatggtgtgaggaatatcgcgcagtttttccgcttcgcccggggtaacgtccggctcatccagatatttccatgcggtcacatcggcggtttctgccatacgcttcatgaaaagcatggcggcgagcacaacgccgacttcaatcgcgatcacaagatcgaaaaatacggtgagcaggaaagttgccaccagcacaatgacatcgctttttggcgctgttttgcagagacggaaaaaggaagtccagtctgccatgttggcagccacaatcagaagaacagcggcaagcgttgtcatcgggatcaaagcggcaagcggcatgagcaccagaaggataatggttaaggtaatacagtgcacgatgccggcgaccggggtgcggccgccgttgcggacgttggctgcggtacgggcgatcgcaccggttgccgggataccgccgaaaataccggaaaaaatatttccgagtccctgaccgaccagctcggcgttggatttgtgggtatcaccgatcattccgtccgagacgacagcggacagcagggattcgatgcctgccagcagcgcgatggtaaatgccggtgagagcatttcctgcaccagtttcatggacagtgccggaacatgcggtgtcgggaaggaggaagaaagctctccgtagacactgccgatggtgttgaccgggagatccgcgaagtagacaacggcggtcgtgacaataatcgcaatcagagatcccggaatcttgtcggtgactttcggccagagcagcatgatgacaatagctgcggcgcccacagcggtggcagtccagttgatggtggaaatatttgtggcgtaggcaatgaccttatccacgaacccggacggcacggatgcgatggagagtccgaagaaatccttgagctggccgacaaacagggtcacagcgataccgcaggtaaaaccggttgtgatggtataaggaatatatttaatgagagaaccaaagtggcagattcccattacgatcagaaaaatgccggcaagaatggttgcgacagtaaggcctgccgtgccataatccgtgacaatgccatagatgatgactacaaaggctgccgtaggaccaccgatctgcacacggctgccgccgaaaaacgagataaaaaatccagcgatgatggcagtatagagcccctgctccggcccgacgccggatgcgatggcaagcgcgatcgacagtggcagggcaatgatggcaacgatgataccggagatcacgtcgcgcatggcctgttctttgctgtagtcctttaagacgtcaaatagttttggtttcaattcattcattttcatttcctcagtctgtaattattaaatttttataaacacaagtcagaattttagcactttacaaacgcgaacgcaagaacgcatgggaaaaaatacaagcacatggaaaggtgagcaaaactgggaaaaatggaagacattttacaggaaaaagaagatgtgaaaagccggattgtatgctaagatagatgataataaatgatataggaagaaaggcggcaatcatggcggagtcgggcaattcttatcagaagatctatgaaatcgtaaagcagattccaaagggatgtgtggcatcttacggacaggtggcggcgcttgcagggaatcccagatgggcaagagtggttggctacgcgcttcacgtgaacccggatcccgcgcatattccctgttaccgtgtggtgaaccgggaaggcagactttcggatgcctttgcattcggcggtgtgaatgagcagaagctgctgctggaggcagagggcgtcgaagtaactgacggctatgtggatatggaactgtatcagtggaagaagttccggatttaagagagacggaggagaaatatgcaaaaaaaggaactggcacttcaggtgatagagcgcttgaaaaaggagtatccggacacgggatgctcgctggattatgacgatgcatggaagcttctggtcagtgtgagactggcggcacagtgtaccgatgcgagagtcaatgtggtcgtgcaggatctgtaccgggaattcccggatgtggatgcacttgcggatgcagatgtggaggagattgagcgcattgtaaaaccgtgcgggctgggacatagcaaggcgcgcgacatctccgcctgcatgaagatgttgaaggaaaagtaccagggaaaggtaccggaagattttgatgcactgttagaacttccgggagtcggcagaaaaagcgccaatctggtgatgggggatgtctttggacagccggcaatcgtcaccgatacgcactgtatccgcctggtgaaccgcatcgggcttgtggacgggatcagggaaccaaagaaagtggagatggcactctggaagctgattccgccggaggagagcaatgatttctgccacaggcttgtggatcacgggcgtgcagtctgtaccgcgcggacagcaccgtactgcgaccgctgctgtctcaatgacatctgcaaaaaggccggaatttagaaaaagataaaataaatcaatatatttgattaaaaacgcaccttgcggaagcgtaaggggtatgatagtatatacgaaatgaataacagaaatcaactttcttgaattattttgtatggaggaaagatatgaatattgcagcaaaatacggaaaatcatactttatgccgccggaggtgacatatgactgggtgaagaaggacagcattgagaagccgcccatctggtgcagcgtggatctgcgggatggtaatcaggcgctgattgagccgatgggactggaggaaaagcttgaatttttccggatgctggtcgacatcggatttaaggagatcgaggtcggtttcccggcagcttcggacacggaatacaatttcatgcgtgcgttaatcgagcgcgacatgatcccgaaggatgtgacggtgcaggttttaacccaggcaagagaacatattataaggaagacatttgaggcggtcaagggagcgcctcacgcagtcattcatctgtacaattccacttcggtggcacagcgggaacaggtgtttaagaagagcaaggaagaagtcaagaagctggcagtggacggggcagaattgttaaagacactcgcggcggagacggacggcaattttacgtttgagtacagtccggaaagcttcccgggcacagaggtggactatgcggtggaggtctgcaatgcagtgctcgatgtctggaagccggatgcagagcacaaggcgatcatcaacattccgaccacggtacagattgcgatgccgcatgtatttgcctgccagatcgagtatattcacaagcatttgaaatacagggataatgtggtgttgagcgttcacccgcacaatgacagaggatgcggcatcagcgatgcggagttcggtattcttgccggtgcggatcgcgtggagggcactcttttcggaaacggagagcgcaccggaaacgttgatattgtgacgctggcgatgaatatggtgtgccacggtgtcgatccgaagcttgatttttccaatatcagcgagatccgcgagaaatacgagcgctttaccggtatgcgggtttacgagcgtacaccgtatgccggagatctggtatttaccgcattttccggttcccatcaggatgccatctccaagggtatggcgtggagagaagcgggcaagagcggcgaccgctgggatgtgccgtacctgccgctggatccgaaggatgtcggaagggaatacgagtcggatgtcatccgcatcaacagccagtccggcaagggcggagtcgcattcgtattaaagcagaacttcggtatggatctgccggataagatgaaggaagaagtcggttatctggtcaagggtgtatcggatcgcagacatcaggaactctcgccggaagcaatttaccggatttttgaagaacattatgtcaacctgtgcgatgcttttcagatttcagagtgtcatttcgagcagaaggacggcatcacatcacgcctggtgatcgagcacaacaaggagcgccgcacgattgagacgacaggaaacggccgcctggacgccgtgagcaacgcaatcaagatgtatttcggcatcagctacgagcttgccgtatacgaggagcacgccatttcagaaggatcctcctccaaggctgcggcgtatgtggagattatctgcaagggcaagaattactggggcgtcggaattgacgaggatattatcaccagctcgatcgcggcattggtatccgctgccaacaagatgttaaagagtgagaacatcgtggagggacgcgaggagcggattgttgacatcatgaattacatacagaatcactatgcggatgtgacgctggatgtgctggcagatcagtttaatctctccaaaccgtacctttccaaatacattaaggaaaagtccgggatgaccttccaggatgcggtgaagaaggcacgcatgaaaaaagcacgcaccatgttaaaggagacgaaccagaccgtagagtcgattgccgcctacgtgggttacgagaatgtggagcattttaaccggctgttcaaaaaagcgtatgagatgacgccggtgcagtttcgcagaaaatatcagtaattctcaaagaatagaatgacaactgggaacaggggaaaggtattgtggtactttttccctgttttttactgacagacagaaacaataatggtataataggagaatcttaggtaaggaggatgcatgatggaagagtttaaacagcttgaaatctacctgtttcctatagtgatgctccttgccatcggaatgaataactggaagcgggaggaacggacgcagggagaccggattttcgggtttcttccgtttctgattatctgcatgatgggcagtgatgtgacgtatcatgcactgcagctttatgtacatcggtttacggtgctgtatgccgggtatctggtgtactgcttcttcctgacagcagtaccgtatgcctggcttttgtatgtgaacggaaagctttctgtgcggcataaccggcggtggacggctgcggtatgccatgttatgacaggaaccgctattgctgtggtgctgcttacggtgatcattccctggagactgagcacggaaggatggggcgtgcatgcggtgtcctacagcttaaatcacggcagtctgccggcaaagctggtaagtattgcgatgtatctgatgggacttattctgacagcgacggcgtatccgaaggaggttaccaaggaagggcagaaagagacgcgctatctgcttgaggcaggcgtgttcagccttgtgggcggaatggtgcagagctttgcggagagctggcgcacgggaggaccttttgtggcactggcagtactgtttatttatctgaatgcgcagaaccggcagatcacgacagacgggttgaccggactgaataaccgcagggagtttgacgcacatctgcagcggaagatcgaattgtgcccggagcacgagtggggacttctgatgattgatgtggatgatttcaagcggatcaacgatgaactgggacatgcggtgggcgatgaggcgctctggcatacagcggatattctgcggggggtgttcggcaaagatccggtatttctcgcacgctatggaggggatgagtttgcggtgctcggagactggtttgggcaggaacagattgaggaagcgatcgcgcggatccaggaaggtatcgaccggtttaacaaagagggacagcttccgctgcagctgtccatgagtatcggctacgcgttctggcatgaagccggaaggcgcggggagaacctgatacagcaggcggatgagcggatgtatgaggagaaacagaaaaagaaacgtatgcgcgcatagagcgcggtgcatggggaggcggactgcgtgagtacggcagcatttttacagatcaatttcataccggcggttgcgctgcttatgatgcgccataataccaggcggacgctgtctttttcgtggaggacacgcgtgctgcgcacggagatgctgctgtttgtactgcttttactgtgccgcacagcgattttgtgcaatctcggaaaaggcggatttggtccaaggattttgttaaaggggctgggggtgtggtatgcgttcggccttttggcatgcgcctacctgtgctttttgtatgtgctggatgtggcgcaggacggaaacggacagagagggataaaatgctggattctggcgataccggcactgatcggcagtgctgtgctgctctcaaacccgtggacgaaggcggtctattttatcaatatggtgaattactataaaaagggacctgcggcatatctgatacctgccgtgggcatgttataccttgtggtggcattccttcttgctgcgtttggtgcgcgccgtgccggaagtgcgcagcgcaggggagaactggggaagcttgccgccgcgtttttgttccctgctgcgggcattctggtagaaaaaatattttccatggatgccgcatgggcgttcacggttgcagcattgctgtgggtgtatcttggtattcagaaaggtcaggtaacgcaggacggactgaccggtcttaacaacagacgcagactggatcagtatatgtgggaacttgacgagcgcagcggagagcgggagacctgctgctatctgctgatggatgtgaacaagttcaagaaagtaaacgatacctacggtcacgtgaccggcgacgaggtgctcaggctggtggcggagcagttaaagcgcacctttggcaatatgcaggcgtttctggcacgctacggcggggatgaattcgttgtgattgtaaaaggtaagacgcaggacgagatggacgtgattattcatcagacacaggagaatgtaaatgcaattgcctggggagcggataccccgtggcagctgtcgatcagtatcggctgcgcgatgcggggagagcagggaaagcaaaaaagccatgaactgctggcgcttgcggatgagcgcatgtaccgccagaaaaaaggtatacaggacagataatccgggcatactctcttcatacgttccgatgggagcagaagacggagggttagtgcaatgaaggatggagaagtgagagactttggcaggcgggataagatcggctacatgttcggtgactttggcaacgattttacctttatttttgccagctcgtttctgatggtattctataccaaggtactcggtatcagcggtggaatggtggggacactgtttctggtcgcacgatttgtggatgcattcacggatgtgacgatgggacgcatcgtcgacgcggcaccgccggcgcgggatggaaagttccgatgctggatccgcaggatgtgcggaccggtggcgctgtcgagttttttaatgtaccagactgccatggcgcaggcatctatgccgtggaagattgtctacatgtatgttacttatcttttgtggggaagtattttttatacatcgatcaacattccgtatggttcgatggcatctgcgatcacgacggaggcatcggagcggacggcattatcgacattccggtcgattggggcgacactggcggggcttgtgatcggcatcgtgacgccgctttttctgtacacgaccgatgcagacggcaatcaggtcgtgcgcggcggcggaacatttacggtggttgcgggcattttctcgattctcgcgttactctgctatctggtctgttaccgcatgactacggagcgggtggcggtggagcgtgacgtggacgcggaatctgtgagttttgcggcaacgctcggtgcgattgcgaggagccgtgcgcttctcggaatgattggagccgcggtatttctgctgctctcccagctgttaatcagcacgatgaacaattatatttatccggattacttcggggatgcccgcggcatctcgctgttcacgctgctgtccacactggtgattctgctggtggtagcgccgctcggtgtgcctgtttccagacgatttgggaaaaaggaggcgtccgtggcggggatgctgttctccggtgttgtatttgcagtcatgtatgtgctgaaattacagaatatgtggctgtttctgtggctcggggcaatcggatatctcgggcttggcttttttaatacagtgatctgggcgaatatcacggatgtcatcgatgatcaggaagtgcagaccgggcaccgggatgacggaaccgtctatgcggtatattcgtttgccagaaaggtcggacaggcgctggcaggaggcatcggaggatgggcgctgcaggtgatcgggtatgagccggctgcggcggcgcagacggatgtggtgcggcgtggattgtacaccacagcaacgctggtgcctgcgatcggattttttgttgtggcagcgattctgtggtttgtgtacccgctggataagcggcgcgtggagaaaaacgtggaggaactcaagaaaaaacatctgcccgctgagcactgactggtgcggcgggcagatgttttttctctgccggggattactcgatttcgatgacgctcaccgggcagccgtcagcggcttcctgcgtggcatcttcctgttccggcgtcggctgatgatagacctccgatacattttcatcgttcatccggaagacctccggacatacactggcacacagcccgcagctgatacagccttcgatcacatttgctttcatagggcatcctttctgtgaacctcccgggggaggtgaatgatggttacctgtttagggttgccggtgtaaacgcgtcatatacgaaaaagccgttaagaaaccgctaagaaattaagaaaaagatgattttacaaatacaagtttgatataaaaagaatatatgttacaataattagcaaatgcggaaaggatggtgggagaaatggcgaacagcaaaagacataagttggtatgctgtctgatggcgatggctctcctgctgtcttttttttatgtggtaccggatccggcaggcaaggcggagcgtggaaatgctgcagcctgcgtggcagacgggcaggctgctctgacgggagagatgaggcacgaaggttcctggcagaatatgatgtctgcacagacgctgctggaagcaagggacgcaaatccggatgcctgcacagatacgttcacgatgattcattccgtgctggatgaagtcgtcatgcgggagcaggcgggcatgcgcagcctgctgtccaaactgctggcggtggttgtgtgggtgatgcttctggtatgcgttgtctgccggattctaagccgccgttacggatgtcgcatgatttaccattgggagaatatctattatatacaccagacagatggaaagaaaggagattgctttctgaattacttacatatatagaaaaacgtaatgacaggaggcagtttcagtgaactataaaaaccaaataagtgacagagtaaagattttgctgattgatgaggatgaaagtattttttatctgatccgcagggtgctgctgcgggagaactataggctttatacttccaccagcggacgctccggcatggagatgagcaccagtatctgcccggatctgattctgatggatacccagctttccgatatggacgggattggtctgatccagtggttcagagagtggacggattgtccgattctcgttgtatccggacagacgggatatatggataaagtcaatgccctgtatgcgggagcggacgactacattgtcaagccgtttcatgagcaggagcttgcggcgagaatttacaccgcgctgcgcagaaggattccgggaggacagggaagcttttatcaggcaggagatctgaagattgatttttcaagacgacaggtaagccttgccggggaggagattcatttttcgccagtggaataccggattctggagtgtcttgccctcaattcgggaactgtggtgacgtatcagatgttgttagagaagatatggggaccgtatgcaagcagcggcagccgtattctgcgggtcaatatgacaaatatccgcaagaagatagagaagatcccgatggatccgacgtacattaccacgatcccgcgtgtgggctaccgcatgcttgagagtcagacggcatcggttgtctgagctgaggttgaagcggaagctttggatgatgaagtgcctttgccttcaaaataggaatcatagattccgtagataaaacctccgataatgataagaataccgatcacagaaaaaatgtgttcaaagattgtcatataaaatccccctttggtttcagttgtcatcaagtataacagccaggaaaacggagggggattttgccgcttttttttaattttttcatagtgtaccaggaagagacttaacacttttttagcagcgggagccaggcagaggcaatattgtatgctttttgaacaaaatggctatattttgttaaataaagtactttttcgtagaaatatatggcaatatttgtgttttttgctataataagggtaatatgttaagaaacagggagaaggttatcaatatgaaaaaggggaagaagcaggcaaagcgaagaaacgcgaatgttacgatggcatttggaatccgggagaagatcgtgctgtgttttcttgtgccggttctgtttatgattgtgcttggaattatttcctaccgcaaggcggcggacggaatgagcagttcctatcgcgattccacgcagcagacgatcgagatggcgttgcagaatatcgatacgagcaactcgttcatcagtgcagaggcattaaaatacgtggtggattcggatcttggaaagtattttgtggggatttacgacaatgatccaacgtccaagcgggcgttgattgaccaggtgaagacaagaattcttgcttcccaggtcggcaactcctatatcagcaatatctatattattccttccggcgatctgcagatgatctcgacgaagagcaaggcgcagaagggcatttaccaagagtacatggatgagatggcggctgatggcaagctgggacagtgggatgaccatcacaatgcgctggatgagtatctgagcatcgacccgtccggatacattatggtatatcaggcaaccgcgcagaacggtaaggcggttatcgtaatcgacatcaaggcggaggcagtcacagagttcatgcagggactgaatctgggagacggaagcattgtgggattcgtgactgcaggcggcagagagcttgcagtgaagcgcaatgcgggagacgaacagggaacgccggtcgagggagagacgatttttgcagacaaggatttttatctgcaggcgagtgagacggacggcgtaagccaggtgcagtacaacggaacagagtatctgtttttccacagcaagagtgaggataccggggcaacgatgtgtgcactggtgccgttaaaggtcattaccggacaggcagagtccattaagcagatcacgatagcgggagttctgatctccagtatcattgcacttttgatcggaaccgcagtgacaagcggaatccgcaagaatatgaagcgtatttccggaagccttgaggttgtggcggaaggtaatctggcaacgaccgtgtccgtgaagggacgcgacgagttccgcggacttgctgctgcggcaaatgacatgatcgcacacaacaagcagctggtgcagaaggtcagccaggcgacggataagctggcggcatctgccggtgaagtgacgaatgcatccggtattattcaggagtattcgcaggatatagcaaacgcgatcggtgagatcaacgagggcatggagcggcagtccacacatgcgcaggagtgcgtgagcaagacgggaacgctttccgaggagattcaggaagtcaaccgtgtggcgcgcgaggtagagacgcttgtgtctgaggcggaggagatgatccgcaaaggtatggaccggatcgaacagctgggacagcgcgcgaatgagacgacagctgtgaccgcgaaggtggaagaaagcatcgaagacttgaagcgcgaatcggagacgatcaatcagtttgtttctgtcattacagatatttcggagcagacgaacctgttatcgctcaatgcatcgattgaggcggcaagagccggagaggcaggacgcggatttgcggttgtagccgaggagatccgtaagcttgcagacaattcggcggaggctgccggagagatccgcaataatgtggagaatatcagtgcgcagaccggcgtgagcgtcgagagcgcaaagcaggcgggcgagatggttgcacagcagaccgaagcagtgcgtgaggttatcggtgtattccaggatatgagcgatgccatggataagctgtttgacggattaaaggagattcttgccggaacggagcgtgccgataaggagcgcgaggatacgcttgaggcagtacataatatttcttctatcattgaggagacggcagcaagcgccgaagtggtgaagaaggttgccgcaagtctggagcagaatgtagagaacttaaacggcacggcggagagcctgggagataatatgacaggtcttaagaccgagatcgccgtatttaagacagaataggcgaagaacatttagagaatataatagaagataaaaaagcggcagccagtcgatcatgagatcggctggctgccgcttcttgaacgcagagagaactgcattttataaagcaaaatttgcaggggtcacactgcatcagaacgcgcaatcagaggttcaggcaggaaagattaagcagaaactgccggtgcagcagctctctggagagtatagcagactgaaaggagtcaagcgcaagctgatagacattcgcatactgtacatagtgccagtgaagttccgtctgccagttgtcgagtgtgatcaggcggtcttcatccagatgaaaatcaaacagatggctgcgcagctcgtaaagggcggcatagcggaacaggttggcgagcatatggcatgccttatctgtgtcagtgatggcaggcagacgcacgctgccatagcgcttaagccctgcaaaccgggagccggttccggaaaggttctgggcgatctcggtctcgagaagtgtgccaaaatcggtgttgtagtagtttaaggtggcagcgaccagggtatccgtcaactggacaaaggacggatggtgcagacagtcatgctgctcaaaatactcgtccataaagtcatagagaacaaaagactcgcagctgaagtgatattccggacggtatgcatttaaaaactgcggcagcaaaacagccagtgcgtccgtgtgatgcatcaggcacaggcagagtgctgcgtagaagttccggcagtccacgagcagggcatccagcggcagattgccgtctgcgtaaggcaggctggcagcctctggcgcatgatcttctatcagagagttgataactggtgtggtggtgccgaaaggaacccctgcagtcagcacaatggcggcatacagataaaacggttcaaagccgtccgctgcgatggaaggcgagaaatagtcgtctgcagagagataatcctccagtgtctcaaagctgtcctcggccgacgggcaggaaacctgatctgcgaggaattgtgcgagatccggatgctcttctgacacgcaggatagaaaacgaaagagcgagtaggtgagaacacgctgtctgccggcaggctccttcgtgtagtttacaagaaatgcggggggaaataattgatcgttataagtttccatgaagaactccttttccaaaagtaatccgtatgtgtgtgcggacggatgcccgcagcgcataccgacatcatagcacattttagaattagatgccatcatgcgttttcattttccgtcaggtgtgttacaataacaagcagacatagaaagcagacagagggaaaaagatgccaaaacagaatcaaccaaaggaagagaaaagagaaaaggggacagcacaagcggtcatccgtgagattttaagctgggtgataccgtttgtaatcgcgcttgccgttgcgatgtttttgaaaaattatattatcatcaatgccgatgtgccgaccgggtcgatggagaacaccatcatgccgggggatcgtctgatcggaaaccgtctggcataccggagcaagtcgccggagcgcggtgatattgtcattttccgttatccggacaacgaggaagaactgtatgtgaagcgtgtgatcgggcttccgggcgagaccgtggatatccgggacggatacatttatattgacggagcggatacgccgctggacgaggattatctcaaagaggactggacggtggcgacggggaattatcattttgaggtgccggaagactcttatctgatgctgggggataatcggaatgattcgtgggacgcacgatactggacgaatccgtatgtgagagaggataagattctgggcaaggcggcagtgatctactggccggtgcatgatattggaaagcttgagtaggggagaagcgatcgagggggtagttttatggttacattattggcgaagatattcattcaggagaagaacgatcaggcgaagattcgtgaagaatatggtgtgctgtgcggtgtggtaggtattctgttcaatgtactgctctttgcgggaaaatttcttgcgggtaccatcagccattccattgccatcacggcagatgcggtcaacaacctgtcggatgcgggatcttcgatcgtgacgctggcgggcttcaagctggcaggcacaaagccggacccggagcatccgttcggacatggcaggattgagtatatctcggggctggtggtggcagcagcgattcttctgatggcatatgaattgatccgggattcggtgggcaaaatcgtacatccggaggagacagagttctccggactgattgttgtgattctggtgttgtcgattctggtgaagctgtatatgtatttttacaatcacatgatcgggaaaaagcttgattccgcggcaatgcaggcaacagcgatcgacagcctgagtgatacctgcgcgacaacggcagttcttgcggcaacactgatcggacattttacaggacttcacatcgacggatggtgcggtgtgctggttggtgtattcatcctgtatgcggggatcagcgcggcgaaggagacactcaatccgctgttgggacagccgccggcagaggattttgtcatgcagatcgaccggattgtcatgtcgcatccggagatctgcgggatccatgatctgatcgtgcacgattacggtccggggcgcaagatggtgacgctgcatgcggaagtgccggcagacggcgatattctggaagtacatgatgtgattgacaacgtggagaatgaactgcgggagaagctggggtgtgaggcgacgatacatatggacccgattgtgacctccgatgagcacgtcagtgaactgaaagccgctgtcgtatcgatcacaaagggaatagatgatgtgattacgatccatgattttagggtagtcagcggtccgacccattccaacctgatcttcgatgtgctggtgccgttccagttcaagatgagcgatgaggaactggttgcggcgatctgcggaagagtcacggaatgcctgggggataattactacccgaagattaaggttgatcatgcctatgtaaaataaaacgaagaagattgcggatgtaaaggaattgccgcaataagcagagtcctctttggagtgataagtaatattatgagaagcatgcccctgcgatttctggtggaatgcctatggaacattctgttcaaaaaatgcggcatttctaaccagccggtgactgcatctgcgatgatccgtgtctttccaagtttggagcactctacggactgtgtccgcaagccaacagacaattttaggacttttgtgtgtcccttatggcaccaatgaacaaaacataaccgcgcgaagccgatgtctaaattggcatctgccctattttcaatagcagatgccaacgagtttcggttcgcgcggttttatattgtctgtgaagcggtgccattagggacactagaaagtccgctcattgtctgtggcttgtcggacacactccgagagagtccaaacgtggaagagacacggaatcagatgcagtcatccggctggaagaaatacacacatttttctccaacgaatgtttcatatgcagttccacccgaaatctgcatcatgcgcttcctgtaatattacttatcaaagtaaagtacggtatgcttattacggcagttccttttagcatctagttgttggaatctgatgcagcttcggaagtgacggctgagctgtcggctttggaggtcgtttcggagctgcctgtctcagagctttctgtttctgtgttcttcatctcggaactttcggtctcagagcttttcatttcagagttttctgtttctgtgttcttcatctcggtagcggacgtctccggaatctcggtcggatcttctgtctccggaacaatatccggatcttcgtagataacctcgccggtaccggcacggagcagtaggctcttggaaccgaggatattcacggtaatggtatcgccgttctgcacattgtccaggctggtcgtaatcaggttcgatgtcaggaacgtggtaggaaccttattgccgtttacaaaaatcttcgtattcttggtaaagttcgcaccgtacaccgtcaaggtattgttgcttgtattcttgcggacagaggagacggtaacgtcctccacatccatcacaaggtcggatgcagggtagcggtcctctccgccgtaggtgtagcgtttgccgtacagcagatcgtactgcagatcctccagaccggaaagataggtctcggaagcggtctgtgtctgatgataacggaacatggttccctcatgaatacctgcctgatcggtaatgtgagcgagaagctggtaagcggtcagatcagcatctttttttgcaagccccatgttgttccaggtgatgtacttggtcttgaaaatatcaccggacttcatatccgcatcggtgagtcccatcgttggaagatgatcgccgaagaacacgatgatggtgtcctctccgcggcggtcaaccgctgtgatcagatctccgatgaagtcatccacttcatgaatcatgttgacataatattcccactggttgttggaagcctcatctgcggcgccggaaacaagaatatccggattttccagaatcttctcggtcgggtaatcgccgtgaccttccacggtaatggtatatacgaaatcggactggttttccgtcgcgttcatagcttttacagtctcctgtaccagcacatcatcagtcggccagttgccattcggcgtgtactgggagatgttcatgcactccttgctggtaaaggtatcgaatcccatcatggaaaaagcattgttgcggctgtagaaagtagcggtattgttatgtacgacatgcgtaccataaccgatctgggagagatcatcggcaatactttcgcagtccgtctgttttaagatcgtcttgtaaggatactcaccggtaccgaaatactgcatgctcattccggtcagaacctcgaactccgtattggcggtacctgcacccacgaccggtacggtaaggtaaccggtggaatagtttgcctcaaggttgtggaaattcggaatcggatcttcggacatatttaaaaagtttacttcgtaaggatcacagaaggactccagtaaaacacagataacatttggctcgctgcctgtggaaacagtggtcgggctgctggcggaatcaacaagggtgttgatcgcatcaacggtttcctcggaataatcctccggtttatccatgcctcttccgacaacactggtggaaaaaccgtacacaaaaccgtaatcagagtagccctgcgcaatatttgcaaaataggaagcaagaatgttggaactctgtgctgcctgtgtggtaatcggaagaccgattaaaatcagagcggcaatggagaccggaccaagcacggtatggcgttttccctgataacggggtccctttgcaaagagaagaccaagaatgacaaagaaggcaaccacaacggacacgaccatggttgcttcctccgctgtaaaatagttggtgttctgcattgcgaacagatccggcagacattttaagtctgtgtagctgaacggtgtgacacggtttgacagaatcagaccgttgacggttccaaggaaaatccacaaaccgctgattaagatacgcatctgtgtacgatattttgtcagatagacaagggatagagatgcaaagataatcagcgcattatataagaatgcaagcgtgtgattgctgatgaaagttatagcgctcacaaagtcccgtctggaaatcgtctccacggcaagaattaacagacaggctaataaaaagtggaaaataagagaatacttattaaggaaagcaatccgtttatagtatttttcactgtgtggcttcttctgcggaagaatgctcttcagagattgaagcttactggaaagcggtgcaagcttttcttttagaatgttaaataattttttcatagaaccctcccaaaatgactgtaggcggtgtgaaacaccgatacgctcacgcgtgcaatatatgtgggcagccgggctgccgattctccagtgtaaaactcctgtaaaaaggaagtaaagctaaatttcgatactaagagaatatagcgctaattgcatcaaaaatcaatcgggaagatgaataaaaaaggtttaagatttcctggatttctataaaatatgaataaaaaatgaacaaactatgtccaaatgaaaaatgtatcactttacaaacttgtcgatcgcgtcatttaagtcccggatgacctgctcatccccggtttcaacggcgtcgaccaggcagtggctgatgtgatcctctaaaatgattttaccgatattgttgatggcggaacgcaccgccgcaatctgaacaagcacttcgctgcagtccctgtcgtcttcgatcatcgtgcggacggcctccatatgtccgatcgcacggttcatgcggtttaagaccgccttggtattctcgtggtgatgcggatgtgtgtgagtggagccgtgggcatgagtatgaacggagccgctggcatgagtatgaacggtgtcgtcagcatgcgtgtgagtggtgccgtcggtgtgtgtatgagtggtgccgtcaacgtgcgtatgagtgatgccgtcggcgtgtatatgtgtatttgctgtggaagtcttctgtgttttcatgggattcctccgattcgttgcatttcattcagtgtatcatattctcccgaaaaaaaacaggttgtcttttttgtacaatgcttatataataaggaaagaatttggcagacaagggggtatatcggggatataccccttattttacgcgaaaagcgcaaaggaaggaatagaaaaaggatgaatttactcgacatcataggacctgtgatggtaggaccgtcaagttcacatacagcgggagctgtgaagatcggcagagtcagcagaaagcttttagcggaggaggttgcggacgcaaaaatatattttcatggctcttttctggcaacgggcaagggacacggtacggataaggcgatcctggcaggactgctcgggatgcaggtggatgatccgagaatcccggagagctttacgatggcaaaggagtctgggatgagttttacactggaggggattgatcttggagatgtacatcccaactcggtcaagatgaatctgaccggaaaatccggccgtacgctggaagtcattgcggcgtcggtaggaggcggacagatccggatctgcgagctggacgggctgacagcgaatttcagcggggattatccgaccctgatcgtgcacaacatcgaccagccagggcatgtggctgaggtgacttcgatgctggcgcacaagtcggtaaatattgctacgatgcagctttaccgcgagagccggggcaccagggcggtcatggtcatcgagtgcgacagagaggtgccgggagaggcaatcgagtggctggagcatctggagggaattttaaaggttacctacttaagcatgctggaagcatagatacatcagatgggcagaaagatgcagcgtatgtgacgggaaggcggtgtgaaccgtctggatgatagaaaaacagagggaggatgacaatgtaccgatcattggaggaactgtgccggatggagagagagaccgggaagcctttttggaaaattgtgcaggaggatgactgcgtggagcagggcatcagcgcagaggagtcgtttgcacagatgcgcgggatgtaccaggcaatgcagtatgcagatgcacattacgatgagacgttaaagtcagcaagtggactggtcggaacagagggaaccaggatgaagcgggcgcgggaggcgggaacgctgctctgcggagactttatcggaaaagtgatggaaaaagcgctgaagaccagcgagtccaatgcctgcatgaagcggatcgtggcggcaccgaccgcaggctcctgcggtgtggtaccggcagtgtttttgagtgtgcaggaggagcgcggtttttctgaggagtgtatggtggaagccctgtacgtggcagccggaatcggcggcgtgattgcaaaccgggcgtttttggcaggcgcggcaggcggctgtcaggcggagattggttcggcttccgcgatggcggcaggtggtgtgacgtatcttctgggcggcggtgcagatgagattgccaatgcagcggcgctggcgcttaagaatctgcttggactggcatgcgatccggtggcgggacttgtagaagttccgtgtgtgaagcgcaatgtcatgggagccgtgaatgccatgacttctgcagatatgacgatggcggggatcttcagtaagattccgccggatgaagtgattgacgcgatgcgcagtatcgggcgcagcatgaatgaggatatccgtgagaccggaaaaggagggcttgcggggacgccgaccggggtagagatccgcgaccggatggctggaaccctgtagacaaccggttagtgccggaggacggctgacagatgggaagtggaatggtaacaggattgacaggatctgaaggggaagaatcatcctgttccagaatggaagcaggcgtggagaatcgttggagcaaaatacgtgaatttcttgcatgccgcttttgacattatattccgtgtctttgccacgtttggacaatccacaggaggtgtccggcaaaccgcagacaatgggcggactttctggtgtccctaagggcaccgcttcacagacaatataaaaccgcgcgaaccgaaactcgttggcatctgctattgaaaataaggcagatgccaattcaaacatcggcttcgcgcggttatgttctgttcagcggtgcccgtaagggacacacacaaaagtcctaaaattgtctgcaggttgcgaacaccttctgcggagtgttccaaacttggaaagacatggatcatcgaagatgtcaaaagcggcatgcttagaaattccgtatttggcgattggattctccacgcctgctttcatctggaacatggctgttcttctggcctcagatagtgaaactatatgcaacattccacgtcccgtccgtcagtcgtcctccggtactagcggttgcttcttctccagatgtgcatctgctccgcctctttgatgaggtcgtcgcggaaatcgggatgcgcgatcgagatcagagcctcggctctctgccaggtagacagaccctttaagttcaccttgccgtattcggttacaacatagtgtgtattcggtcttgcgtcggtaacgatggaaccgtttgccagcgtcgggcggatacgggactgcacctgaccgtccttggtcttgaaggtagaggataagcagataaagctcttgccgcccttggacagataagctccgagcacgaagtcaagctgtccgcctgcgccgctgatctgcttgatgcctgcagactctgcatttacctgaccatagagatcaatatccacggcattgttgatggaaataaagttatccagtgcggagatcgagcggatgtcgttcgtgtagtcgaccggagcgctcatcagttccgggttgtcgtccagataatcgtacattttcttggtgccggcgccgaaagcgtaggtctggcggtaacggtcgatattctttttggaaccgttgatcttacctgcctttgcaatatcgacaaatgcatccacgtacatctcagtgtgaacgccgagatccttcaagtcggactctgcaatcagggaaccgacagcgtttggcatgccgccgataccgagctgtaagcaggcaccgttcggaatctcatcgacgatcagctttgcgacagccttatccacatctgtagcaggaccgcctgcacccagttcaccgattggcgggttggagccttccacgatgtaggtgacatcggaaatgtggatgccacactcggtaccgccgaggcagcgtggcatattttcattgacttctacgatgatgtgctttgcgcgctcgcacattgcacccagatgtgaggcactcggaccgaagttaaagtagccgtgcgcatccatcggagcaacctggaacatggcaacgtcatccgggcagtcaagctcgcggtagtagcgcggcagctcggagtagcggatcggacagtagtaagccacgcctctgtttatcatcttgcgctcgataccggacatatgccaggagttccagcagaaatgctcacctgcatcctcacgtgcaaaaacagccagcggcttcatcaggataccgccgcgcagcttgacgtctgtcagttcgtcggtgcgctttgcgagagcctgatccagtgcgtcaacggtgttggtgcaccagccgtaatctacccagtctccggatttgatgagctttaccgcctcatctgcggagacaagcttctgtttgtattcttcacgaaaatccatctcaaatacctcccacacaaaagattgttaaaattttaccatagtttcatcctatcactttatgtcgtattttacaagccctgccggagcgtatttccggagatttgtaagatcaggtctcctccggcatccgccagtctctggaagcctcccggtatttgtcgagcatcatttcgtactggatggtaagcgctgtgtcggaaggaattttggcttcctccccggcgaggagcgtctcgtaacattcgacaagaccgagcagcggaagatccccgcttgtgtgaacgtccaggatgctttccgtctcataggcggcattgtagaaccagagaaccgcttccgcgtagtcgcgctgtcccacaaaataggttcccagttcgtagcagatttctgcgcacggtgtggtgagcatgtccttcatggtcagcttgaaaaattcgttcttgttatcctccatgcggtaaatccgggcgaggacgcatgcagcttcctttcgggcgtcatctgccgggtcattgtcgaaaatgagctggaagatcggttttgcatcggtaaaatcctttttgtcgccagtctttagaagttctttggcatacatggtacggattttcggggaaaattgtccgtcgtgttcaaacgctttgatgaagatggagaagtcgcgcttgctgtgcagggactgcggacagtgcagaatctccacatcgctgtcaaaagtgaccggcgttaagcggacggtctcgtgaattggatcgatccaggtaaacgtgcgcagtctgcggaacagctttggacggtattccttttttgcattcaaaacggtatcgaatgtgccctgcgtcacatacttcatctgtacaatctcgatctcaggcagaagggcatctttaagacggagaaaacgctcgcggtttgcgtcgtcaagaatttcatcggcgtcggcggtgtagatatattccatcgttgctttggaaaaggaaaaattgcgcgcggcggaaaagtcgctggtccatttgaaatcgtagatccgcgaggtgtactgtgcggcaatttctttcgtgttgtcggtggagccggtgtctacaatgatgatctcgtccatgagatcggcgatgctgtccagacagcgcgccagcactgcggactcattttttacaatcatacataaactgatagttgccatagtttctcctttgtgggaggcagtgatatgccgctgccccgtgcgtgataacttctatcctaagtataacgcagcgggggatggcaggcaaacaggaaaataaattgtcgtggcaagatggaaggttctgtgctaaaatgagcggtggttatgtctgcagggcggacggaagacagatggaaacggagtatacagataaatgagacaaaaagaacaatttatgcagaagacgatcgtcgtgtggcagcccgggaaatgttgcagtcttcgggtttatgaatccggtgtgtggtgtgatcctgtccgcagttctgctcggtgagacggacagcttaagtgtgatgccggtggctgcgctggtgctggtatgcatgggaatttacattgtaaaccgaccggaaaagacagaataaaaaaggaggaacctatgagcgcgattgttacattaaaaaaaggtgagggaagaaccatcaaagccggaggaatgtgggtgttcgacaatgagattgacacggtgaccggaacatttgagaacggcgaagtggtgctggtacacgattttgacggttatccgatgggaagaggttttatcaacgtcaattccaagatccgggtccggatgctgacaagaaagatcgatcaggaaatagaccgcgcatttttgcagatgcgtgtgcagaatgcatgggattaccgcaagacgacggtggacacctcctcctgccgcgtgattttcggggaggcggatttcctgccgggactggttgtagataaatatgaggacgtgctggtcgtggagtgcctggcgcttggaatggagcagttcaaggagacgatcgtggaacttttaaaggagactctggtgaaggatggcatctgcatccgtggcgtttacgagagaagcgatgcgaacgagcgcacgaaggaaggcttgccgaaggtaaagggatttatcggcggggagttcgacacgaacgtggagattgtggagaatggcgttcattatatggtggacatcgtgaacggacagaagaccggatttttcctggatcagaagtacaaccgccttgccatgcagcggatctgtaaggggaaaaaggttctggactgttttacacacatgggaacgtttgccttaaatgcaggaattgcgggcgccgcagaggtcacgggacttgatatttccgagtatgcggtggagcaggcgcgggagaatgcgcgtcggaacgggctggaggacacggtgcagttccgctgtgccaatgtgctggatgaactgccgaagctggcacagagcggcgagcagtacgacgtcgtgattcttgatccgccggcattcacgaagtcgcgtcaggcgacgaaaaatgcaattaaaggttaccgtgagattaacatgaaaggcctaaagcttgtgaaggacggcggctatcttgccacctgttcgtgttcacactttatgacacaggagcttttggagaagaccgtgaaagaagcagcaaaggcgacgcacaggagactccggcaggtagaattcagaacgcaggcaccggatcatccgattctctgggcaaattcggcgaatgtgccagagagctattatctgaagttttttatcttccaggtggtagacgaacgctaagcgttcgtgatgaaaagtaagcggctgaaagtggcggaaatgcttgatttacaaggggtggaaggtgtttagtgcttagcttgcaaacctcgtaaaatatcgcaaaatatcgtatcacagtggtataaagtggtaagaaaagtggtaagtctgagtggtaagcacctaaaatgtaatgagtggtaactatgaaatgataatgatatcggagaaggttatacgttcgctcttcataatacggaaatttctagtatagatgtagcgttttgtggtatactatagaagaacaaatacctttctgcgaaagggaaaggagaaaggatacgcgtatgacagttgatagaagagtaagcagtattgaatccagtttcaaaatggaaggcatgccatttgatgcagaatgtcgtcaaagagtaagaaatgtcttggtcaagaaggtttctgcggcagatgcaatttcagaattaaataagaaatacagagtatccaagaagcaggttgaaggatcaagagtatgattatttctatgatgatgaacaggatgctaagtactgttatccgggcacaaatgtattaaagaataaactggatataaaagatttagatacattgcacgaggctgaaagagactattcggcagtacgtcaggcagaacttgtaggtcaaggcgttaccggggatttctcttttaagcatctttgctctatacataagcatttattcagtgatgtatattcttgggcgggcaagacgagaacggttgatatttccaaaggaaccgttttctgtttggtgcagtttatcgaaagccagtttgatgatttgtattgtaagctgaaaaaggaaaatttcttagctgacataaccgataaggaagaaatgagcgagagactagcctattatctgggtgagattaatatgatccatccgtttagagatggtaatgtaacattgggacaccagctaaaagtcgcataacagcaacaaacgactttttacaatctttacaataaaattgaataacatatagattagagaatacctataaaacggtattctttttttgttaaaagacgttcaaaattgagcgtctatttttttacccaaaaacaaaatgaaaggagcatttagaattatgaaaaagatattaaaacgattgtgtacgggcttccttgcctttgcgactgtcgttactgctttaccgagtacggcagtttatgcgtctgatacacagtattggacggaaagtgatgagcgtgtcggtatcgttgaaaaagtaatgaatgacgcttcgattggttctacattcaatgagggacacatgaaagttgagggcgaggacgcttattgtattgacatcaacaccgattttaaaaatcgatataagaccagagctgacgctagttcacgtatgagtgccgaccagatagccgacgttgcgttatctattgaatatgtgaagcagtacgcaaacacaaggacattgaggacgacagacagacggtgcttatcacagagcgtatcatcaaaattcatacgacggctacggacaaagacggcaaaaaagagattgaagctggaaaagatgtaactatcgttgatacggtcaagttagagggcttagaagtcggcacgaagtatcagcttgtgggctggcagatgttaaaagaagaaaatgccgagctaatcatcaatgataaacgtgttgagaatgattacatctttacggctgacagcgaaactatggaagtgaaaatcgagtttacttttgacgcttccactcttggcggtaaacaacttgtaacttttgaggaattatacgatttaagtaatccagataaacctatcaaagttactgaacataaggacattgaggacgacggacagacggttattattaaagaagtaccagaaacgcctaccccagaagaaccagagaagccagtcacaccagatacaccaacaaaaacagacagtcccaaaacgggcgacaatacaaatatccttgcctttgcgattatgatgtttgtttctgctggcggtttagctggtacatacttcttcaaacgccgtaagatgaaaaaatcataaggcggtaacgatatgaagaaagaaaaatcacgttctccgccgtagcttagataggcagactatatcttattctggcttgtctaccgacaacctgcaagaacacggatagtcaagggtgcgttagcatttatttaccctttactatctgggggattgctggtatctcattaactgccagaataaacaacaatcaaattcaaggaaagaaacgaggtaaaacactatggaattaaaatatatcgtgccgaacgtggcacagacttttggaaacttggaatttgctggggaaaataaagtagaacagcaacgtatcaacggacgctacactcccgtatcaagaagctacaacttgtattcggatattcaaagagccgacgatattatcgttgtgcttcctgcaaaggctggcgagaaaaactttaaaccagaacagcgtgtcaaacttatcaatccaaagattaccgcagagggctacaacgtcaagggacgtggatttacaaactacattttaatggctgatgatatgttaccagcagaaagtaaataagggggtattcgattatgagattagcaaatggaattgtattagataacgagaaaacttttggagtattgaaattctctgcacttcgacatgaggtgcgtgtagagaatgaggacgggacgacaagcgaggaaatcaagcgtcgtacctatgatttgaaatgtagcgtgcaggaacgcatgatacaagtatcaatctctgctgatgttcccgtaaaggattttccttacaatgcagaagtcgagcttgtcaatcccgtagctgatacggtggcaaatgccaactttagagggactacgattgattggtacatcaaggcagatgatattgttttgaagaacaaaggcggtcaagctggcaatccacagaacaatgctccgcagggacagcagaaaaagtaagctggtaaactagattttcattgtagcgattatatgaaattgttataatgtgaatatgttaaaagtacgatttatagtcaagaatatttgaatattttgcaaaaaaacacgattgcaactgtcagttgacatatttccattcctaaatggtggctgtgcaactgccaatattgctacaataaccatgaagaaaggagtgctgaaaatgaatatgtcagacagaatacaatatttaagaaaaacaaaaggaatatcacaagaggaacttgctgataaggttggtgtttcaagacaagctgtttctaaatgggaaagtgagcaaagtacaccagatttagaaaaagtaattataatgagcgacttttttggagtaactactgattacattctaaaaggcattgagccagttactgataaggaacaaaaaagtaaagagattgcaagcaaaatactttatatctcatcaacagcttttgttgctattgggttactctgtgcttttggtgggtggtatgaattacaaacaatggaagctgttgcaggttcaatgattattcaagcggtaggaattgttgggtattttattgcaagaatattatcagaagaaaaagcaacattttatgtaagttggtttaatataattgggattgcttttatgcctatttctatgattacgggatatatttctatccttgttttcaaacaaggctgggtagcaccttatccaaatggaatatttcatactttaactttcatattactattcttcgtggttttagttgcaagttatgctattctaaaaaagcgagcaaaataaatttatgttcattaagcggttagtcattatgattgaccgctttttccatacccagaaaggagtgattgatttatgagaatgatgttaaatagaggacaccgtatcagagccagcgacaagacacttgtttaccgcttctgtgcaggtacgcttctgtttctgttcttagcggtactattgcttttgaacatgggacagctcatgcgtaccgattgggagcatttcagcttattgaagaacggcttgacgcttttcccttacaacttcataaccatactgatagcgacgggtatatgtgtacttgtcgcttttctgtattaccgcttctgctatgacagtttcaagaagctgttgcaccgtcaaaagctggcacgcatagccaatacgtacttatgtactggcgtacacgagcagaactgtctggcatagaaagcaatatcagcaggcgagccattaacaatgaataaagctacagaataagggaaggactgccggatgtggtatttcacagtcttcgtcatacgagtatacttgtctgaggagtttcatcagctggcagtccagaagaaagactcataatcttcttcataaaatgtgctccctttcattcatacaacgtaaaagactaacgaacatatttaatgaaacatcgaaaccatcttctttttgttgtttacctataataacgattggagtagtcgattatagacactgcaatcaaaaaaatctgaaaatatatttatcaacattacataaaagtgtgtagatgcacataaaatgggaatatatattgaaattcaggtcgttctgtgatagaatcttattactaaaaagtgtgcagatgcacggaaatggggagtgtaacgatggagattaaaagagacgcttacctacagcagctgatcaagcgaaaagataatggaatgataaaggtgattaccggcattcgtagatgtggcaaatcctttttgctgtttaccatctttaagagatacttactggagaacggtgttgatgttgatcatattattgagattgcattggacggtattgaaaatgaggaactaagagatcctaaggtgtgtttcaagtacatcaaagatgccatgaaagacgatggcaaatactatctgcttcttgatgaagtgcagtttatgtcacaatttgaggaagtgctgaacagcctgctccgcatgagcaatattgatgtgtatgtcaccggaagtaattccaagttcctgtccagcgacattgtgaccgaattccgtggcagaggtgatgagattagaatctaccctctctcctttgcagagttttattctgtctatgacggcgattatgatgatgcatgggatgactacatgatctacggaggattgccgcagatcgtaagtttccagagcgaacgacagaaagcggactatctgaagaacatctttgcaaatgtctatctgaaggatgttattgaaagaaataagattcagaacgtggatgagattgggattctggttgatgtgcttgcatctgcaattggcgcaccgaccaacccttcaaagattgccaatatctttgccagtgagcgccagatgacttatgctaataaaaccatctccaagcatatcgactatttgacagatgcctttttgatttccaaggcaagccgatacgatattaagggcagaaagtatatcggtgcaaatctgaaatactactttacggatctgggactgagaaatgcacgtctgaatttcagacaacaggagcctactcatatcatggagaacattgtttataacgagctgttgatccgtggctataatgttgatgtgggtgtcgtggatatcttcgataaggataaagagggcaaacgtgttcgcaagcagttggaggttgactttgtggtgaatcaaggaaaccagagatactatatccaggttgcatatgacatgacttcggaagaaaaacagacgcaggagttcaattctctgcgtaatatcccggactctttcaagaagatcgtcattgtaaatggcagcaaaaagccttggagaaatgatgaaggttttgtcatcatgggaatgaagtatttcttgctgaatgcgaatagtctggaattttaagtcgatttgagttgttgctgtggtgttgttctatttcaaaaaagagtgaaatgatataaataaggccagccgatgtggtagcatttatgtgggagtacatgaaagtaccggaggattcaagagaaaaagttaagaatctgcttaaagatgcaaatgaaaatggagtaaagataagtcatcaggcaccaacactgtatgatgttgttccgaaagaagaaattgctgaatttgaagaacttatgcgcaaaaccatagctgacattgtatcagaagccagtagcgttgcctgttgggtgtatgtgcagaaatatgtgaagcacaaaaccctaaacgaaatgctgcaagaattgccagacgtaagtcaattcatcctagctatggatacctggtttgaaaaactgatggttatcgaagctatcattgaagcagataatgaaatgcagagaataaaagacaaaattggtatgttacacgaaatttagggagaaaactgagcaagtaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtggaatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataacctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagcccgatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatctggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatggaacgacctttcaaaaaacagttgatttagaagttaactgtttttgaaaggccgtttttgctatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatattgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagtatttcctatgttagcagtatatgcataccatgcttattgtcattatgaaaaaaacgaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattttgaagaaagaggcgtttgatcagaaaggacttatttatggaatgggacatgctgtatattctatttccgatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagttttttttaaagagcatcaatgttgaaagtatatttgaatttgtcgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacgtaccttgttttgacgaacaaggcaattgaattaagtaattgtcagaaagaaaaaatgatagaagcttatgaaaaaatcatatcgaatatacaagaagatgacctggaagttacacggtgtacattgagaaaaatccgacagcttatggaagaaataaaatagtgattaatacaacggagtaagaaaagctccttcatatattagaataaaaatatgactgtttctttaaaaagaagcctgtcatatttttttatgaaaaataaattttgttgaggttaaattgagattgactttgtattgtatcagtatgaaataaaaaggaatcaggtgatgtacaatgaaaaagtataaaatatgtaaaatccttcttgttatactggcaatttttttatgtatggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccatggaagatgatgggtagaatgcatgataaatatttgattgcagatggaaagagatatattcttgggggaagaaatacatacaattatttcctgggtgattttccgggacataagaactatgacagagacgtgttagtagtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgattcagatttttctatcatgacaaattcagttgcaaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaggtcaaaagtgcatcggatggagcactggcattagaaatattggataaagagtatattgatctgatcatttccgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagttggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcactcgtattttcaacagtcatatctgcgttattatttgcttttttgaatcatttttttaatctgcctggtagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctgatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagtccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcaaatttgttgtagagcttccaatacagaaagatgagaccatataagtttaagaaaaacagatagaggaggaattacatgacattttatcaggagttgcagttaaatcaggcaggttctaaaaacctgttgaaaaagagtgaaacactaaaagaaaaattatatcatatgtgggtatatctggtgaagatagctgctacaatggcattttgttttttctttgttagtattttcagtatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcaaatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtcagcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctacagagacttatggactacaagaagcggttagtcttagagtgattcaaaatgtttttggtgttgtgtttgctttagcattttgtgttatattttattggtttatgtctaaaaaaacggttcatgcgggactcaatgtacgctttaatgaagaaaaacagattacttctgataacgaaattcaaaagtgggcgaaatagattgtaaaatagtactcttagcggaactaatcaggtgataggtaacatttacttcaggatcagttaagggaatccgtttccgccctttcagagtctgctctgagccgggtgctttactgctggaaaaacataataatgtggaagtcctgaccaattcttcaaactcaaattcatctgtctgtatcagaaagcgggatgctggcattttgctctttaccagatttgtccagaaaccgatttcatcacgaagaaggcagttaaaaccgttaagctgtggaaggctcagctgtgaatgttctgccagtttgtgttctttcgggatgcagacatagagctgttccttaagataagggatgcagagaagatttttatctgaacaggactgtggaagaataccgatatcagcattgccggaactgacattttgaaggatttcatccatatttgtcagttttgaggaaataatattatcagggaatctgcgtgacaattcaggcaataatgaccatagaggtacgggagcacaggaatgaatggtaatcgtatgctgattgcgttcaaatgtctgtacggtctcaaccgctttttctgcttcagaaagcagagaccttgcctgttctaccgctacttcaccggtatcggttaattcgatacggtttttaccacgatgaaagagtggaaccccaaaagcatcttccacatcatgcatggttctggtaagagtgggctgagaaatatgaagtttatctgccgcagcagataaggtaccacagtctgcgtaggttacaaactggtaaaggtctgataagtctaacattttgatactcctttctattcataatatgaatagtagatttcgaaattgatattgtatatattcattctaacagaatataatttgaacgtaaacagaaaacaagaaatatcatatttcataaaatgaatacaaaaggaggacgaaacaatggattatgttacattaaataatggtgtaaaaatgccgcaacttggctatggagtttatcagactccgccggaagaaacagagcgctgcgtacttgctgcaattaaaaacggataccgcagcattgacactgctcaggcatatggtaatgaagaaggcgtaggtcaggcaattgtaaaatgcagcctgccaagagaggaacttttcattaccacaaagatctggatcagcaatgcaggatatgaaaaggcaaaggcttcgattgaggaatccttgaagaaactgaaaacagactatgtggatctgcttttgattcatcagccatttggtgattattacggaacataccgtgcaatggaggaagcctataaagcaggcaaggcacgtgcaatcggtgtttcaaacttctatccggaccgttatatcgacattgcacatttcgcagaagttgttccagcggtaaatcaggtggaaacacatgtattccagcagcagaaagtggctcgagaatatcttgcaaaatatcatacacagatcatgagctggggaccatttgcagaaggaaagaatgatttcttcaatactccggcactgaaagaaatcggagcaaaatatggaaagagtgtagctcaggtggcacttcgcttcctgcttcagaatggagtcgttgtgattccaaaatcaacgcacgaagaaagaatgcaggagaatttcaatgtatttgattttgtgctgacagatgaggaaatgaagcagattgaaacacttgataccggaaagagtttgttcttttcccattattcaccggaaacagtggaatggtttatgagtattgtgtaacaaaatagcttcataaaggcaatagcgtattgcggtttatgcgaccggcaatacgcttttgctgtataataggatatgattgtttcctattaggaacgctgtaaatacaaggcttttcggagcctacgaaccacaaaaaataatatttgatctatcacattacacaaaaagccgtccggcgttcaaatcgggcggcttttttgcgtggatagaccggaaggaggcggaaaaataattacagaaatttaacccgcaaaattgtgcaactttcacgaaaaggaggatagtgaatggcagatgaaaaattgaacacaggccccggtgaggagaagctcccggaggctcccgctcctgttacggttgacgagccccaggctccggctcccgaacaaactgccgctcccacaccccagcaggaggggcctgcccagcccgagcccggtgatgtggtggtgtcctttgacaaaatcaatgagctgatgaatgaaaagcggcagacagcccgggccgaggtagaaaaagaggaggcggcaaaagagccgaaggagaaaacgcaggaggaacctcccaccgctggggatgatgaacctaaaaaggcccgtcggggccgtcccccaaaagaggaaaaagcggatcctgctggcaaggaggcggcgaagccccgcaagggccgcccacccaaggcggataaggcggcccccggcgaggccacgccgactaagcgagacaaattgtcccgaagtgggaaaaaggctgcggaggttaaagctgccccggaacccgaaaaggccccacccgaaaatgcggctccggccccggaacaggctccgcctgagccagccgctccgccccgtcctgtggaggaaggaaagctggtctatctgaagctttccgaaatgcatccgttccacacattccgcccccacccgtttaaggtgcgggacgatgccaaaatgcaggaaacggtagcgtccatcaaggcaaacggcgtaatggttcccggtcttgcccgcccggaaaaggatggcaagggttatgaaattgtggcaggccatcgccgccatcatggttgtgagctggccgggctggaggaaatgccctttatcgtccgggaaatgactgaccacgaggcggtacaggccatgaaggacagcaacaagcagagggatcagacgctccccagcgaactggccgccctgttggaactggaagtggaggacatcaagcaccagggcgggcggctgaaaaatgtggccgagggcgatattggaaaacgctccgttgagatcgtgggcgaggcgcacgacatgaactataaaaaggtcatgcgttatctgcggctgaactcccttgtgccggaactgctggacaaggtggacgataaaaaaatgggctttatgcccgctgtggagatttcctatatccgccccaaaaaccagcggctgatcgctgtttccattgacggagaacaggcatccccctctctggcccaggcgaaaaagctccgggagctggacaaggacgggaaactcaatggtgatgtcattgatggcatcttatcagaaaagaaaaaggaggatcgaggcgtgattatttctaccgctgaactggaaaagtattttggcaaggaagccactcccgccaaaatgaaggagcagatcatgactttgctggacgagtggaaagagaaacagccgcccgaactggcgaaggctccgaaaaagatggagcaggacaagtaaccacttcgagacattttgtcccgagggccctgccctccgcatcatggctctggtggtatatatcccccgtcgccgcctgttttttcgtacagccgggagcgggctgtcaagggtgcatcgcaccgccgttttacggcggcctgcccttgacggtctgccccggctgtgctatttccccggcaagcggcgggggtatatcctccagagccgccccctttcccatgattgggaaagggcggggggattgggttgaactttcttattaaaatatcggaggtattgactatgaagcgtccccttgcatacattaccgccgcatggttgagcggcgacagtgaaaacgcagaacaggccgcccgctactgccgggcggtttatgaggcaggcttttccccaatctgcccgcccctttatctgcccctgtttctcaatgacgcagtacccgaggagcataaaagcggcatcgacatgggccgtgacctgctccgccgctcccatgtgctggtggtctgcggccacaccatgaccgaggccatgaaaaatgatattgccgtggcccagcggctgggaattaccgccaccacccttgagggcatcctgaccgtcaagggacagggcaaacgctgatggagtctgtttttgaggctttcatttcaaatcctgccctttacagtgcggggcatctggtgggggaaacgctgcatttccccaccaacacggaggaggtgcagtccctcttaaagcggatcggcgtggacggggtgcgctgccaggaatactttattatctcctttgacagcgacattctcggcctttatgactatctgggcgagtatgaaaacattgacgagctcaaccacctggcccatctgctgaaggagctctccccatcagaacgggaaacgctggaggcggttatggacagcgaccagcattgtggctcggtgcaggacttgatcaaccttacgcaaaatctggactgctacgacctgcatcccggtgtggacaatgaggaaatgctgggccgcctttatgtggaggatatggaaagtctcgaagtgccggacaatataaaaccctactttgactttgaagcatacgggcaggacatttccatcaacgaaaacggacactttgcaccgggcggctatgtgacgaaggtgagtgacgatttccgggaggtctaccacggcccccaggacatccccgctgaacacagggtttttgcttaccctcagctttcgatccgggagcagatggccgcttatcaagaaattattgacggttcctcaaaggaggggttccggcggctggctgaaaaacaccatgaggaacggtaactggacttcgagacaatttgtcccaaggcgaaaggaggcggtgtaactgattgatgaagaaatttcccggagctccatagcgatttctgtccgggccagcaagctgacagcccgggggctggcctatgtgctccgggcggctggccgccagatcgccaaacggcataagaaagcccaaaggccccacggcaggcagagcgtgaaaaagctcatggcccacggcgaaaatgtgaacagcatcgaggtggaggccccgaagctctttgaccgcatggcccgccgtttcaatgtggactatgctttttacaaaaccgggccggacaaatacctgctgtttttcaaggcaggacaggcggatgcaattaccgcctgttttgagcggtactcccgcaggctgttggaacagtcaaaatccagccgcatccccatccgggaacaactcaaaaaagcggcggaacagcttgtaaaggaaccgcccaaaacacaggaacggacaaaggaggtggttcgtgaagaacgatagcatcaaaaaataccttattcccaacatcccgtatctgtttgtcctgtgggcctttctcaagctggggacggcctaccgtctggcggcgggtgcggattttgctcataagctcatggggctgggccagaccattggcccggcctttgccgactttgccccggggcttgctccctttgactggctcgttggcattgtgggggctgtggcgttccgggtaatggtctatgtgaaaagtaaaaacgctaaaaaatttcggcgggatgaggagtatggatcagcccgttggggctgtccgaaagatatagcccctttcgtagatccaaagtttgaaaacaacatcattctgaccgggacggagttccttaccatgaatacccgtccgaaaaatccggccaacgcccgcaacctcaatgcctgtgtgatcggttcgtccggctccggcaaaacccggttctggcttaccccgcagattttgcaggccagcgcagacaaaaacggcggatgcagctatgtgtgtgtcgatcccaaaggaggcgttctcgggcaggtgggccacttcctgcaaaagcgtgggtatcggatcaaggtgttcaattccattgatttcacaaaatccatgcactataacccgctggcgtacatccgcaacgaggccgacatccttaaatttgtggacgctctcatttccaacacaaaaggcgaaggcaaggaaggcgatccattctggacaaaatcggaaaccctgctttactgcgccctcatcgcctatatcatttttgagggccccgccgaggatcggaacatgaacacattggttgacatgatttccgggatggaggtcaaggaggatgacgaggattttatgaacgccgtggactatatgtttgcgggcctggaaaaacgaaagccggattgctttgcggtcaagcagtataaaaagtacaaactggccagcggcaaaacagcaaagtcgatccttatttcctgcggtgcaaggctggctccctttgacatcccccagcttagggaggtcatggcctatgacgagctggagcttgaccgcatcggggatcgaaaaacggcggtgttctttatcatctcggacactacgcaaacctataatttccttgtggctctggccttttcgcagatgttcaatctgctgtgcgagagggccgacaatgttcacggaggccgcctgccccatcatgtacgggtgctgtgggacgaggccgccaacacagggcaggttccccagcttgaaaagatcgtggctgtcatccgttcccgtgagatcagcttaacgctgttctatcagcagttggcgcagtgtaaggcgatttacgataaacacgccgaaaccattttgggaaatatggacagcgtgatattcctcgggggccgggaggccagcaccatcaaggaaatatccgagaactggctgggtaaggctacaatctccatgcagaccgacagccgctcccgtggccagtcggaaagctacagccaaaataaccagcggctgggccgggagctgatgacacccagcgaactggcgaccatgcccggggataagtgtattttacagcttcggggcctgcccccgttctattccccaaaatacgatttgaaaaagcacccgaactaccgatatacggctgaagccgacaaaaagaaaaacgcctttgaccttgaccggctcattaaccgccgcaggcggcccgggccggacgagctgtgtgaggtgtatgccgtggctgtgccggacgatgggctcacaagcgaggacgaggacatcctcaattatgatgacatcgacgatccggacgcctttgcataaatagggctttgggacaaagtgtcccgaagtatgtaacctgccgccagaaatggcggcttttttcatggccgggaataccccccggagaaaaggaggctctatgcagtttttcacttccgctattgatactttgcagactcttgttgtagccctcggcgctggacttggcgtgtggggcgttgtcaatctgctggagggctatggatcggacaacccaggttccaagagccagggcatgaagcagctcatggctggcggcggcatcatccttttgggaaccacgctgatccccctgctgtctggcttgttctaaggagggcttatggattttctcaccgactggctcacgaactggctgaaagagctgttgatcagcggtatcatggggaacctcgaagggctttttgataccgtcaatgccaaagtcggagagattgcggtacaggtagggactaccccggcggcatggaacgccagggttttctccctcatccgccagctttccgaaacggtgatcctgccgattgccggattggtgctgacctttgttgccacctacgagctgatacagatgcttttggaaaagaacaatatgcacgagtttgatgtggcgaatatctacaaatgggtattcaaaaccgcttgtgccatcctcattctttccaacacctttaatattgtcatggcggtgttcgatgtgtcgcagagcgtgattgcggatgcggcggggctcatccaaggctccaccgacattacgccggatatgctgacggagctggaaatcacgctggagggcatggacttggggccgctccttggcctgtggctccagtcctctgtgatcgggctgaccatgcagatcatggggatcatcattttcgttctggtgtacggaagaatgattgaaatatatttaatgaccagtttagcacccctgcccgttgccacgctttccaaccgggagctgggcggcacagggcagaactacctaaaatccctgttcgccgtaggctttcaagggatgctcatactggtctgtgttgcgatctatgcggtgcttattcaaggcatcgccacaggcggcgatccgattggagcgatatggggaaccgtgggctatacggttcttctgtgcttcatgctgtttaagacaggcggcatcgcccagcgcatcttcggggcgcattaaacggacggacttcgggacaaagtgtcccgaggccgggaaaggaggaaacaattttgagtaaggatgtcatattaaccccggaacagatcgccgccgaggagcggcgctggctgtttgatgcgccgattgcggagctggccgaggtaaaaggcgtgacggtggacgaggcagttaagctgcggacggacgcaattttgcaggaggccgctgttcccatcgaagttacggttcgcccgattgagccccaaggcaagctcatcggctttgccagcgtcaactatggcggtgtagtgatcgacgatttcaaggtggtggatggcaagaacgggattttcctcggggctcccagcaaacccgatcccaccagcaggacgggctaccgctccacggtgcggatcaatgaccgggccacccaggagcggctcaatgcggcgggagcccaggcgtaccattcagcggtggaaaagctcatcgcccgggccgaggcagtccgccccaccccgatcaaggagcagatggcacaggccgcaagggaggctgggaaggaaaatgccgcccgaaccgccccggcaaagaaaaaggaggcccggaatgacaggtgatgtgacctcgagacaaattgtcccgaagtctccagcctgcccggaggggctgtttttgatggacgggattgaagggctgcgctctttgccgaagcactcggttgatatgctccttaccgatccaccctatggcactacccggaatttttgggatgtgccgctcccgctcccggagctgtgggaggcggtcaagtgggctgtcaaaccggatggcgcagtgctgtttttcgcacaatgcccctatgataaggtgctgggggcatccaacctctctatgctccgctatgaatgggtgtggtacaaaagcaggtgtactggctttctcaatgcaaggcgggctcccctaaagcggacggaaaacattctggtgttttatcaaaaattgccctattacgatccgcagtttgaacagggcaagccctataagaaaatttcccggacaggggacaacagccccaactatggaaaattcctgcgttccagcagcggatcagaggatggccttcgttttcccggaaacctgctggccttttcttccgtacagcgtaccgtccacccaacgcagaaacccgtggagctgtgcgagtatctcatcagaacctatacccggcccggggaggtagtggcagacatctgcgctggctccggcacgactgctgtggctgccgtcaatacgggccgccgctttgtatgctttgaaaccgccccggccttttacgccccagctacagaacgcatccggctggctactgaggcggtcaaagccgggcagaaaggagtatgactatcggaaactattctatcatttacgccgatcccccttggcagtaccagcgcaataaagtacagggggcggcagaaaaccattatcccacaatggggattgacgatctgtgtgcgctcccggtggctgatctggccgccccggacagtgcactttttttgtgggcgactttcccccagctcccggaggccctgcggctcatagaggcgtggggcttccgctataagtctgtggcctttgtctggctgaaaaagaataaaaaggcggacagttggttttatggccttggcttctggacgaggggaaatgcagaaatctgcctgctagctaccaagggccatcccaaacggcaggcggcaaatatccatcagtttatcatttccccgattgaagcccacagcaaaaagccggacgaggcccgggaaaagatcgtggcccttatgggcgacctgccccgggtggagctctttgccagacagtccccgcccggctgggaggtgtggggaaatgaagtgaaaagcacgatcccggactttgggacaaagtgtcccgaggttaaaggggccggaaaggaggctgatccatgccctatgtgaatgtacccaacgacctgtcaaaagtaaaaaccaaaatggccctaaaccttaccaagcgccagctcatctgttttagctgtgcggcggcggtaggcatcccgtcctatctgctggcccggggctctatcggcaataccggggccatgttccttatgctggccgtgatgctcccggcgtttcttctggccatgtatgaaaaagacgggctcccggcggaaaaggtgctgaaaaacatcatacgggcccggtttctgcggtccggagtcaggccctatcagacacaaaacatttacgccccctttgccgaacggggcgctgtgagaaaggaggatgtgattgcgaaaggcaaatccaaccagcggaagaaaaaccgcaaaggctaaaaaccgggcggccctgtccgcccagcagacgatcccctatgtggcgatgcatccggacggggtatgcaagctccccggcgggctctacacaaagaccgtggaatatgaggacatcaattattccgtggcatccactgaggatcagactgcaatctttggcggttggagctcatttctcaactactttgacagctccctgccgttccagctttcctttatcaaccgccgctcccactcccggagccgctataaggtaaacattccccaggcggatgatgattttaacagcgtccgggaggaatttaccgggatgctgaaaaaccagatcgcccggtctaacaacgggattgaacgctccaagtacattactttcggcatcccagccggagggatcgtggaggcccggccccgtctggagcgtgtggaagccgatgtgatgggcaactttaagcggctgggtgttccctgtgaaccgatggacggacgggcaaggctggccctgcttcacagccagatgcatccgggcaaccgggaaccgttccgcttttcatggaaggacatcccgcagacggggcttggcaccaaggactatatcgccccggacagctttgacttccggcactcccgcctgttccgggtgggccagtattggggcgctgtttcctacttgcagattttggcgtctgagctctcggataaactgctggcagaaatgctggagctggatgcggaaatgaccgtaaccctccatatccagacggtggatcagctaaaggccatcaaaaccatcaagggaaaaatctccgacatcgggaaaatgaaggtggaggaacagcggaaggctgtccgggccgggtatgatcccgacattctcccgcccgacctcattaccttttccaaggatgcggcggagctccttgccgacctccagtcccgcaacgaaaggatgttccttttgacttttacggtagtcaatatggcccctacccgccagcggctggaaaatgatgtgtttaccgtgggcggcatcgcacagaaatacaactgcgccctcaagcggctggactggcaacaggagcagggctttgtgtcctcgctggccctcggctacaacgaagtggagatccagcgtggtatgacaaccagctccacagcaatttttatcccctttatgacaagggagctgcggatggacgggcaggccctctactatggcatgaacgccctttcccacaatgtcattatggctgaccgcaaaaagctgaagtcggccaacggaatgtacctcggctctacaggctcgggaaaatcctttgcggcaaagcgggaactgctcaatgtctttctgaccatcccccaggatcggattatcattgtcgatccgatgggcgaatatgccccgctggttcgcaggctgggcggacaggtgatcgagattgccccggacagccaccaccacctaaacccgatggatgtggagcttaacatggccgccggggagagccctctttccatgaaggcagatttcctgctttccctgtgcgagctggtggtaggcggaaaggaaggcttacagcccatcgaaaagacagttgttgaccgctgtgtgcggctggtgtaccgggaacaggcccttgggcttgatacgggaaaaaccccgcttttgcaggacttgtacgaggagctcttgaaacagccggagcccgaggcccggcgtgtggcaaccgcccttgagctctactgcaccggctccctcaacctgtttaaccatcccacgaatgtgaaaaccgacagccgggtggtgtgtatcgtgctgaaaaacatgggagaaaacctccgcaagatcgccatgcacatcacaaatgaatttgtgtcccaggcggtagataccaacttccgggagggcgtggcgacatggtgctacttcgatgagttccatgtcctgctccgtgatccgctgaccgccagctattttgtggcggtgtggaaaatgctgagaaagaaaggctgcgttcccagcgccctcacgcagaatgtaaaagaccttctggccagccgggagattgagaacattctggataacaccgattttatgattttgctctcgcaagctcagagcgaccgggcgattttggcaagacagctcggtatttccgagcatcagctttcctacattacccactctaattccggcgagggcctgctgttttacgggaatgtgaccatcccgtttgtggatcggttcccgaagggggaaatctatgacctcttaaccacccgaccggaggatatgaagaatgaagcgaaaaccgaataaaccacgcccggagtcccaaacgcatacggaacccggaggcggagctgccgagcccggtggccctgcttttggggctggctctgaacaggcgcccggggcggctggcacttcgggacaaagtgtcccaaagtcaaaatttcggcagaaaagccagcaggaacaggcggcggcatccaagctccgcatggaaaagcggggcgaaaaacgggaagccgcccgggaaaagctggcaaagcagaagccgcccaaacaaaaaggcccgatccgtaaggcggcgggggccgccggatggggcgttcacggctttgtgcatggcaagctctacgaggtggagcaggaaaatgtaggaacggaaggggcccaccgttcggaacttgccggggaggttatcctgcggcatggctcccggtttgtaaagcgcaaagtccgggagcatccggcaagggcggccagccgggccgaggccaggtatcagaaagcagcggcggattatcatttccacaccgccgcacaggagcacccggagctttcccaaaactattttacccggtactggcagaaacagcggcttagaaggcaataccagaagcgggcgaaggaggccgcaaaacagggagccaaagccgccgggaaaacagccgccgccacggaaaagctgacagcccgggccgccgggtttgtgaagcgccatccagtcggatgcctgctggctctggcctgtgtccttgtgatcgtcctgctccagtcctgttcgtcctcgctggtgtccatcggcaacgccggagccggggcgctgggggccaccacttacccctctgaggatgaggcgattttaggggcggaggcggcttatgccgggctggaggcagaactgcaaacctaccttgatacctacgaaagcacccacgattatgacgagtaccacttcgatctggacgagatcgaacacgatccctatgtgctcatttccctgctgtcggcgctccatgagggggaatggacgctttcacaggtggagggctccctgcaaatgctctttgaccgccagtatattctgacggagcgtgtggaggtggagacacgctacgacagcgacgatgaaccctattcgtggtacatctgctatgtgacgctggaaaacaaaaacctgtcccacctgcctgtttccctgttgagcgaagaacagatgtcccggtactccatctatatgtccaccctcggcaaccgtcccgacctgtttcccgactccccctatgtagacaaatacattaccaacccgccggagggctatgaggttccgggggaatatctggacgatgaaacattcgccgctattttctcggaggcagagaaatacatcggctatccctatgtgtggggcggctccagcccgtctacatcctttgactgctccggctatgtgtcatgggtgatcaatcactccggctggaatgtgggtcgtcttggggcgcaggggctttacaacatctgcactccgaccagctccccaaggcccggcaaccttgtgtttttcaagggaacctatgataccccgggcgtgagccactgtgggatttatgtaggcgatgggcggatgctccactgcggagatcccatcggatacgcaaacttaaatacaagctactggcagtctcatttttacgcctacgggcgtttaccatgattggaggtcatttatggcaacagcaaaaagcatgaaaatccaagccgagattgataaggtcaaggccaaaatcagcgaacagcaggcccggctcagggagctggagcagaaaaagctggaggcggaaaacagcgagatcgtggacatcgtgcgtggcatgagcatcccccttgcggaactgcccctgctgtttgaaaagctgaaaggcggcggggctttgggacaaagtgtcccgaagtccgaggatgaggaaaaggaggaaaactgaatatgaaacggtttcgagttttgacagcggtgctttgtgccgctgttttgttatgcggctttagcgttcccgcctatgcctacgcaggcggcgagggcgaggactacggcgatcccacaatggaaaccccggccccggagccgactattacgccgggcgagggcttttccgaggagggaaaccttgtaacccgtgatctgctctatgacgagcacaccaacaagcagtttattaccgtacagaccagcggcggcaataccttttacattgtcattgattatgacaagcctgtggacgaggaaggtgaacagtatgaaacctactttttcagcgttgtggatgagggggatctgctggccgcagccgaggccgctggcgtggaacaggcggtctgctcctgtccggagaaatgtgcggcggggactgtgaatacagactgcccggtgtgctccgtcaatctggcaaaatgcgtaggcgcagagccggagcccgagcctgccccagagccggagccggaacccgagaagccgggcaacgccgggatgatccttttggtgctggctgtcatgggcatcggcggcggggccgcatggtatttcaagatttactgtccgaaacaccagcaagctgaccagcccgaggaggacgatggcggggagtacccggactatgacgagtttgaagatgacggccccccgtgggacgaggaggacgaaaccgaagaaaaggaggaaatcagatgaattttaccaacagtccctttgaacgaatgatgaaagaaaaaccccgtccccaggctcccgctgagaacaggccgcccaggggctccgcctgttatggctgctgttactggcgggggatcgcctgtgtgtcctgctacaaggagcttttgaaggccggggctggcgggaggtgatggattgtcccgtgaactgacacgcaaggaaaagacagcgatccgctctcttgtggtaacatggtgcgctaactatgaccgggaatacggatgcctgccgctggatagcgattgctatatgctgggtaaatgctggacgggatcatactgccgctatttccgggagtccgtcctgccccttgatccggcgctggaagtggcccttatgagcgagggcccaaggccggattttaagatatgcccggtatgcggcgggcctgttcccccggacaggcggcaggcgtactgctcggcggcctgtgcaaagaaagcccaccgccgccagcaacgggaatatatgcggaaaaagcggggtgcatccgttgacaattagggcctgtaaaacccgcttatagcaaggctttccggggccatttcgttggcctgccgtatcattctacggtctggccccgtttgccccgatgctgtcaacatccatacagcgggactttgggacactttgtcccgaagtacccgctttctgagaggaggaattatgccgaaatattaccccatcaatgaggaggccgcccggcgtgccaaaaacgccaacagcttttccgactatgttcccggctccgccaccgccgcttaccgtgaaatggtggatcgggcctataccctcgggaaacagcagaaagggcgtgtcgatcccatgtaccacgaaaagattgacgggctcatagaccgctatgcccgcaagctggcggagaacatcaaccagtgcaatctcatagatgcccgtgtaccctcgatcctcatcgccggaggctccaacttcccggtgcggaaaaaggaaaagcagaacgccgcccgggataagaatatgggcgaatatatgcagatcgagggcctgctggataaggtgcgctcaacaggtatgggcgggatcagcgcagacgatgaccgggccgtggaaaagctggaggcgaagctggcagggctggaggccatgcaggaggaaatgaaaaccgtcaatgcctactaccgcaagcataaaacgctggagggctgtcccgtcctgtccgccgaggaaattggaaagttccagtcctctatggcatccgactggcgcaaaaatcccgtaccctatccgtcctatctgcttaccaacaacaacgccaacatccgccgcacacgccagcgcattgaggatttgaaaagccagtcggaatatgcgggctgggcctttcccgggggacgggcggaaatcaacgaaggagaaaaccgcttgcagctcttttttgaggaaaagccatcggaggaacagcggcgggaactgaaaagcaacggttttaagtgggctcccagccagggagcatggcagagacagcttacgaaaaatgccatatatgcggcgggccggatggaatttttgcgcccggaggatgggcagagcccttaccagctccagccctttgcccggaaaacggaaaaggatatgacacgatgaaggaggtgtatttgtggacaaaaatcaaggctattccattttgaaggctgtgatgctggaaaatggcaggggctttgcgctggggcatcatcccacagctccatccccctatgtcacatgggcctgttacgatgataagaacggccagcggcagtatgaatggggacattacggcaacgatctggccgctatggaacaggatttttcagaccgggtaaaggactatcagcggctttactatgtggggatcgtgcagaccgaggcccccggcctttacaaatattactctacccagcggcctgtggacatcgggacattccccaaaccgccccacaatgccccggatgagatcgtcaactatgaccgccgcatcccggtggagggcggcgcatttctggcatgggggcatctgacttatacaagaccgctgaccgaaaaggaggcgtctgactatgagctccgtcctgcctccgtcatttctgaattatcccgaaaaaacgatgacaggcccctctcgattgcccagcagatgaaagaggccggagctctggccgaagccagccagggcgatcccatccataagaaaaaggcccccgaccggggcgaccgataggaggatttgtatggaagaaagatataacccgatgaaaagtgcggagatcgccaccgagcacaattacaatatgctggacggtgttctcaataaccaggccccacccccggaggaaaaggagctggataaggttaaggaaccgccccacaagcgccggagccgggaacgggaggaacgatgacaaagaaacgccgccgcccgatccatctccatgtgatggtgtccgaggaggagcaggcccttattcaacaacgcatggccgagtcgggcatccgcaatatgggggcctatatgcggaaaatggccctcaatggctatgtgctccatgttgacctctcgcccgtccgggagttggtatcgctccagcggcggtgctcaaacaacctcaatcaagtggcgatccaggccaacacctacggcgggatttaccccgaggagatcgccgctttgcaacgggactatgccgccctgtgggggccgctgttcgatctgctgaaaaagctctccgcattggtggagctctgatcctgccggggagtggcgtatgccgctccccggttttcactacttcgggacaatttgtcccgaggtgctgaaagccggaggcatccttgttgtccctcccggacagaggtataattatcatgtaaggaaccataaaccacacttttcaaggaggtatcaagcgatgcggatcattctgaaacttttagcggccccctttgttctggccctcacgctccttgtggcagtattgaattttgctttttcctttgcgtcatgggtgttctgcgccctgtcctttctctgtctgatcggagccctgtttgctttaatcacgggggatcgctggggcatacaggggcttgtgatcgcctttgctgtttcgcccttcggcctgcccgctgtggcggagtggctcattgacaagctggacagtctcaactactcgctaaagagttttatcacaggataacgctttgggacaatttgtcccgaagccccctgcggcggctggacggacagccgccgttttcttttggaaggaggtgtgctcacggctacaacttatatccggccctacaaggtggcggctgggaaaggcgctgtccagacaatggaggaacgctttaactatgggcttaatccgaaaaagctgggagccctgtcctcatacctctgcgatccggccacggctcccgctgagtttctgctggtaaagagtcagtaccaggcggaaatgggccgggccgtagagcgtggagccctgttttttcaaatccggcaggcgttcccacccggcgaagtaacagcagaggaggccaaccagatcggctatgaaacagccatgcgctggacaaagggaaagtatcagttttttgtctgcacccacacagacaagagccacctccacaatcacatttatttcaattcaacggcctttgaccgctcccggaagttccataattttatcggctccagctttgctctgcggcggctctctgaccgggtgtgcgttgagcatgacctctctgtgatccaaaatccaaaacagcacagcaagggccggtatctccattatggccagtggattgtggaaaagccgccctctgcaaaacagcgggtgcggctggccatcgtggaggctctgaaaaaacagcccgccgattttccggcgtttctgaggctcatggaggagaccggctttctggtaaagcatggccgtggcggtgtgatctcctttcttgctcccggacaggataagcccacccgcctgcgggcatctaccctcggggatggttttgatcccgaggacatccgggctatgattgccggggagcgtccgatcccggagctcccgcaggaggctccggctcctgcccggcgtgttaatctgattatagacattcaagagcgcatggcacagggcaagggcccggcctatgaacggtgggccaaggtttacaatctgaaacagatggctgctgcgctccagtacctgcgggaaaatgatttgatggactatgaggcgctggcggccagtacagaaaaggcagtagagcgttttcacacgctgtccgaggaattgcggcaaacggaggcggagctggaaaagacctccgggctcatggcggctactgtggactacgcaaaaacccggcctgtgtttgacggttacaaggcggcccggtacagtaaaaaatatctgtcggagcatgaggcggagcttgccgcttaccgggcggcccgggccactatgaatgagcttttggacggtgcaaaattgccaaagatggcggatatgaaaaagtcccgccaggaattggcgggaaagaaaaaagccctctatgcggaataccgcaaggcccaggcggatatgcggcaggctgtggcggtcaaagcgaacatagatcatctgctcggcgtgacagacgggcgggaaaataaggcccaggagcgatagcgacaggccgcagacaacaggcgcatagcgccggaactttgggacaatttgtcccgaagtccagcgggtttggggagctccccaacaagcatttttgcgggcctgcggccagcaaaaatttcggagtgtggccacacccgaattgcttgccgaaacgcgcaaccccggaagtggcgcgaaaaaacggaggcgcgtgtttctctttacgcatcctccgtttccttggccgctttcatcgcttggattgtagcttcaacgattttcaattctctttcgtccaaggcgttcaacatggcatcaatccgcttcctgcactcgctcccgctattctgggacgggtaaaagtattgatccaccgatatatcaaacattgtgaccatctgataaaaggtgttgaagcttggatgctgaccatcattttcattatacataatggtacgcggagcgcggtcaacaatataggccagttgctcctgtgtcataccgctggcttctcttgcacgcttgatggcgagccctatatcgtgaaaatcaaagcgtctttcatctcgttctatcttcataacatcacctgatatgattttacatttcatgtgatattatttgaacgactgtgtatttcatactactgactatttaatttcacattcttttcttccaaaacttgtattgttcgagtcgaagaactataatatactctatggaggtgcagaatggattatatgacactaaaagaggccgccgaaaaatggggcgtgacacctcgtagagtaaattactattgtgctgccgggcgtattcctggtgctgtaaagatggcaactatctggctaattccaaaagatgcggaaaagccgattgacggaaggacaaaacaaggaaaggagttgcgccatgaataaaatcctgattatagatgatgacaaagagctgtgcactttgattaaacgtagcgtacaagcagaaaacatagaagctgatttttgtaataccggaaaagagggcttacaaaaattaagagagcaggaataccagcttgtggtgctggatgtgatgatgcccggcatggacgggtttgaaacgctggaagaaattcgcaaggagtacagcttgccgattttgatgttcacatctaaaaatgacagcatttctaaagtacggggcttacgggccggagcggacgattatcttacaaaaccgtttgatatggatgaactgattgcccgtattgcgtctcttattcgccgctacactcgctttaatcagcaagctggagccatacaaaagctaaatttttacggattgcagattgaccttgaaaatcgttctgttactacatcaaacggcacttttgaactgcccccaaaggaatttgatttgctcctgtactgtgcaaaacatcaagggaaaattttgaccaaacagcagatttatgaggaagtatggggcgaagaatatttctatgatgacagtaacattatggcgattatcagccgacttcgtaaaaaattagaagtcaatccttcaagcccaaagtatatacaaacggtcaaagggattggctaccggtttaataaggaggtgtagtcagcatggaaattatcgtatccttgtccattgtgattgctgttgtggctgtattgacttccatcgttctcgttcggcgtgtaaaaaaacaaatagcagaaatgaccgatgtgctggttgatgtgaaaaacggaaatggcaaccggcgtattctatctgcaacaaatgaactgacagcacctcttgcctatgaaatcaatgagatcgttgtggcctatgaaagcagactttcaactgtacggcagacagaagaaaccaaccgccaacttatgacgagcctttcccatgacgtgcgaacgccccttactactctgattgggtatcttgacgctgcacacaaaggactggtcacaggaaaagaccgggatgattatattgaaaccgcccgccggaaagcccatgatctgaaagaatatattgatgtactctttgactggttcaagttaaattcaaacgagtttgctttggaaatccagagcgttgaggccgcagagctgacaagaaatatcctcattgactggataccgatttttgaggataaacaggttgagtatgacatcgatattcccgaacagcctgtccgggtaagattggatatggacagctatatgaggatcatcaataaccttattcaaaatgtaatcgctcacagccatgcagacaaaatcaaaattgccctgtcaaagaaggaaaataacatggagttgctgctggcggataatggagtgggaattgagaaggaagatttgaaacacatttttgaacggctctataagtgtgacaaaggacggtctgaaaaaggaagcggtcttggtctttctattgtccatcagcttgtagaaaagatgggtgggagtataacagttgaaagtttgccgggaaaaggaactgaatttatgttgctttttcctttggagagttaagcgggttcccgtctttatggcgggagcctttgtcattttactggatttcaaattgcaaggttaatgcaaggttgcggcaaggttaatgcaaggttggcatgatagaataccttacagaacaggaggttttgaatatggatacaaattatatcattgaaacaaaaaatctgacgaagcaatacggctcacaaaagagtgtggctgacttaaatattcatgtgaagcgtgggagaatttacggtctgctgggcagaaacggagccggaaaaaccactaccatgaaaatgctgttgggcttaacggagccgacttccggggaggtcaaaatctggggaaagtctttgcaagggaatgaaaagaagttgctcccccgcattggcagtctaattgagtcccccggcttttatcccaatctgaccggcacagagaacctgcgtatctttgctactctgcggggcgtaccaaacaatcatgctatcaaagatgctctggatctggtaggactgccctacaaagataaaaagctcttttcacagtattctcttggcatgaagcagcggcttgccatcgcccttgccgttatgcacgatccggagcttttgattttggatgagccgatcaacggcctcgaccccatcggtattgcagaagtacgttcctttattcgtgagctttgtgacgcgcgaggaaaaaccattttgatttccagtcacattctttcggagatttccttgctggctgacgatattggaattatcgaccacggcgcattgctggaagaagaaagccttgctgagctggagcaaaaaagcagtaagcatatccggtttacgctctctgatactgcacaggcggcaagaattttggagcgcaatttccatgaaaaccatttctccatacaggacgaccacaatttgcgcctgcacaaccttgatctacctgtggggaaaattgtaactgcctttgtagaaaacggattggaggtatcagaggcgcatacctgtgaagaaagtcttgaggattatttcaagagagtaacagggggtgagggaattgcttaaactggttcaatgtgagttcgcgaaattgaagagaaaaaaaatcatcccacttgtgtttttgtccgcttttttatttcctattcccattacctttctgatggcaacaccgagaatgttggagaagtacccaaataaatcagtcctttttgatggattgttcaatatggttatgggatatggcgttatttttctcttgccgtgtatcatcggtgtcattgcagcaatgctgttttttatggaacgggacaatgacactttcaaaaatttacgcacaatcccggtaacaagtacacagatgattatggcaaagatcattgtgctatttatttttggagttatcttttgccttgcttccatgcttgctaccattgtttgcggcagtttctcaatggaagtgcatggtcttacctataaactacttgttgcagttgaacttggaatattcattacagcgggaactttgccgattatcgtacttgtggtctttttcagcaaaacatacatcttctccattctgctatgtgtgttttacagtgtagtgagccttaccgtcgaaacattgttcggaacattgcctaaatggttatgttggctcatgcctatcccgcttacaacgctctggggtgcgggagatatggtgaaacatgggtttccattgaatgtaaatgccttggaagcaattattccctcaacctttcagacggttatcattcttgggataatggctgttgcatcaatctcattgatcgacttcttatacaagaaaaggggggaataaaatgtatcggatcattaaaacagaattatggaagttaaagcggtatcatatcatttgggctggtattctgctaatgcttctttccgttggaattactctttttgcttctactgcattagatggtacagtttggactttccctcatttggtcgaacgcgtcattcaaaataatacgacaaccatttttcctatgtgcattactctgattgcaggatatatcattgctcgtgaaaaatcagatgataccttaaaaagcattatgacaatacctgtttcctaccctgcgttgattggcggaaaactgattgtttgcggtttcctgtccgtatttttgggtatggcaagtacattttttactgtcgctgcggaattacttgttggctttccgggattttcggtaacagccgtaatacaggctttgatacagatcacccttaataccttatttttgtatatagccgtaactccgattatagcctttaccgcccgtattcctaacgggcacatgataggtgttattcttgcatttgtctatggctacgggggaatgttcgcagccggaaatatgtcccttgcaaatctctatccgattacagcgagtatgggactgatccagtaccgaagccatgatgcggctgttcattggaatataggcttatgcagcctaagtatgatagtcgtcttattgatttctgtggctattgtagttacaacaaaaaatgtttcatccgcaaaagttgttaaaaagccgaaaaaaaccgccctcaaaaaaggctggtaaacaggaggacttacacatgaagaaaaaaatattgattgggattggtgccggtgctttcgtggcaatctgttttggtattttactgctttcaggtgcaggcagcacctattactattcacagatcgacaacaccaagatcgagcagacgggatctgccggaggtgtaattaactttgggggaagcatggactactcctacacgctgcgttgttatgacgaggacggaaacgaaaaggacattacctttggaacatcgagggaattgaaagaggacgcctttattcgtctgacggtaatgcccattcgtggagtgctggaatgggttgaagttcagtatgacgagcttcccacagccgtacaaaaagaatatacagcaccgcaataaagagaatagataattgattatcacctaaaatatagctgccgcacgacggcaaaagaaaaaaagccgtcgtacagcagacacattttcacgcgcctatgaaatggcggctttgattttcagagccgccgtttctttgcgtttacacaaacctatgacgacttgcagggacacggtagccgattggaggttaatttaccgtgtccttctttttatttcgcagtatccatgacctgcaccagttaaaaaaagcgtagctcccccatcggagcagtccggctttgaatgtgaaattaaacagtacataaccgataatatattttcatgcgcttgtgcggccttgtgtcgcgcaggcgcattttgctttccagacttcgagacaaagtgtcccgaggtgcggtgccgttctccgccgttactccatttcgtttccgaccaaccccgaacaaactgaaatggaggattttacgatgactactatcaatttgaaagatttttattattggtacacgcaggatcagcttatcgaagtttctgacgaggtggccgaggtattcaaggccgatgcccgctatgaaatggcctaccagcggcggctctcccggcacaaggcgcagtattctctggactgcgatgacgggattgagtattccgcttgcctgcatgagccgaccccgcaggagctccttgaacggatggaaacctttcttcgtctgtggaacgctctcaattctctgccggagatccaaggccgtagaattgacgcacatatcattcttggcaagtcgattaaggaaattgccgaggccgagggcgtacatgaggagtctattcgccagtcgatcaagcgtggccttgaacgcatgaaaaaaaatttttgattttttcttcttaacccacttggaattgatgaaaaaatgtctcggtttatgagaggaggttttcttcttaacgcaagggaataacggcaaccctgagtaagtacggggagccagacggtgggtgcgcggtgacatttccctaaagagattgagcgaacaacaccaacactgtaaatgggcccggccatcccaaggccatgatccggcgctgaacaggttggctgcctgttcctccgggcttgtcgctttgcttgcgttgagagcgccgcacagaaaataacgattgtctttggacaggccaagtaaatatgtgcggcgctctctaatattcaaaaactataataaacctcgagacaaagtgtcccaaggtggagtaaggcaacagaccagcatcccggcggtgctggtctgttgcgtttccccaccaaacagagggaggcgttctatcaatctgcgaaggaggtttaccgtgaaattaactacacaggaacttgaacaaatgagaagcgttgacattggcgcggtggctgccgagtccctgcctgatgtgagcggtatgacctttgacaatgcgctttcccgaaaggagcgcatctctcgatttttgcagactgtcaaaaatccatactgcttttgcatcggtggtgttggcgtgaaaattgaatttgctgaaagcgggccatctctccaagataagctgacggatttcctgctgcggcaaagaagcgggctgtaacttcggttacagctcattttgcttcttcgagacaaagtgtcccgaagcggaggcatccttgttgtcctccccggacagagttataatataagtgtaatgtgatagggaaggaggaacaatggcacgagcaaaaaacagagggtatcagcagagtttctctccctcttacacaatccgccgctggcggctgggcatctatatccggctttcaaaggaagatttgaaaaaaggaaaagacgatagcaacagcgtaaagaaccagcgtgacctactgaacgatttttaccgacgcaacattgacgagtttgaaagtatcacggaatatgtagatgacggacatactggaacggacgctaaccgtgaagattttcaacggctcttggcggatgtcgtgagtggtaaaatcaactgcgttatagtaaaagacctgtcccgcttcgcacgaaattatagcgatgccggaagtttgatcgataacctgtttgttcaaatgggtgttcgctttatcagccttgctgagaatgtggacagctacaagaaccccgacagcgtttcaaatatcatcgttcccattacaaacgtgatgaacgataattactgctatcagacttccaaaaagatccggcaggtatttgattacaaacggcgcaacggccagtatatcggagcatttgctccttacggctatgtaaagcacccaaaggacaagcacaggctgattgttgatcccgatgctgctgaaaatgtcaaactcattttcacaatgcttattcaagggtcatcaaaacgtgctatcgcgctgtacctgaacgaacacggcgtaccgagcccctcggcttacaaggtacaaaagggcttgcctgtttcgacaagagggtatgacgatcctatgtggggagtccgcatgatccactccattcttaccaatccgacctacaccggggatttagcccaaggccgaagccgggtgaaaagctacaaggtacaccagattgaagctgttccccgcgaggaatgggtggaagtggctggaacgcatgaggccattatcgactatgaaactttcgacaaggtacaggctctcttacagcgtgatacccgtacttccccgaaaggccgtgaggtacatttattcagcggctttctgaaatgtgccgattgcgggcgggccattacccgatgcgttggcaagaacaacaatgtatattattcttgctcaacctacaagaaccgttcccggacagcctgcaccatgcactcaatcaagcatgaacggctggaggctgctgttctgttcgctgtacagcatcaggtacatttggctgtttcctactcggaaatcgtcacgcagatcaattccgctccaatcaaaaaaagccagtcttaccgactggacgatctgatagctgcaaaagagcgagaactgacaaaaataacacgctacaagcaatctctttatcaggactggaaagacggtgaaatcacccagcaggaataccgggatatgaaggcagactatgaacggcagacttctgatatttccgcagtgctcactcgtctgaacgctgaacgcgcagaactggcaaacggtgtagacaacgagcatcctgcactggtagcctttatgaagtatcagaacattgaagccctcaaccgtgaaatcttggttgagcttgtggactatatcaaggtctatgaaaacggtaatatcagcgtgaaattcaaatttgctgacgagctccgcaagattgccgagtacattgaaatcaacactacggaagataccgcagtagcgggctaacccccgctacgaacccctttgacagtgtgttttcctaataggcgctaatcatatgaaaattgttatacggaaaggataagaaaatgaaggaacagaatcatccgaatgtgattaaaattcgaaatgcacatgttcataacctgaaacatatcgatgtggatattccactaaataagattgtgggaattgccggagtgtccggttccggaaagtcatcccttgcactgggagtgctgtatgcggaaggttcacggagatatcttgatgcgttatcgacctataccagaagaagaatgacacaggcaccgagagcacaggtggatgaggtactgcatattccagcggcactggcattacaccaaagaccgggggttccgggaatccggagtacgtttggaaccggatcggaactgttgaacacattacgactgatattttcaagacttgcaaatcactgttgtccctatggccattatctggaacccacacttgatgtggcggcagggaaagaactttgttgtcctgtctgcggaacacattttttggcaccatcagcggaagaactctcttttaattcgcagggagcctgccagacttgtggcggaacgggatttgttaggaaagtagatgaagcttcgttggttccggatgaatcactgactattgatgaaggtgcggttcttccatggaaaacattgatgtggtcactcatgacagatgtatgcagggaaatgggagtccgtacagatgtaccatttcaggaacttacaaaagaggaaaaagagatcgtatatcatggaccggcagaaaaaaagcatattttttataaagcaaaaaatacaaaccagtccggcgaacttgattttacatatttcaatgctgtatataccgtggagaatgccttatccaaagtaaaagacgagaaaggcatgaaacgtgtggaacgtttcttgaaagaggatgtatgtccggattgcggcggaacaagactttctaagagagcgagactgccaaaattatgcggcatcacactggcagatgcctgtaagatgtcactttcagagcttgtagagtgggtaaatcatgtgccggatgccctgccagaagaaatgcggttaatggcagaaaatatctgtgaatcttttcagatggttgcaaaacggctgatggatctgggtctgggttatctgtcattggacagagcggcttctactctttcgacaggggaacggcagcgaatgcagcttgcacgggcagtcagaaaccggactacaggagtattgtacgtgcttgatgagccgtctatcggtcttcacccatccaatatcgtgggactaacggatgtcatgcatgatctgattgcggatggcaattctgttattctggtggatcatgataagcagattctttcagaggcagactggcttgtggagatgggaccaaaagccggggcagacggaggaagaatcattgcacaggggacgattcctgagattgaagcaaatccggattcccaaattggaacatttctgaaagaaatgcatcccatttatcggaagaaagcatctgaacaggaaatgttttctttgggaaccatccacctttcgacagatgctattcatacggtaaagccgctggaagcagatattccaaaagggagacttacagtggtgaccggtgtctccggttccgggaaaacgacattgatactggaaagtctgattccggcattagagtcgatgataaatggaacaaaacttccctctcatgtgaaaaatattactgcggaagatattgaacaggtaaaactgattgatgcggcaccgattggaatcaatgtgcgttctacggtggcaacttatgcaaatgtgcatgatgagttgcgaaaggtatatgcaaaacttccggatgcaaaggaagcgggatataaagcaggggatttttcttacaatacaggaaaactgcgttgcccgacctgcgatggaacaggttctatcagccttgatgtgcagtttttaccggatgtggaagtaccttgtccggattgtcatggaagcagatataacagggacgctgggaatattaaaaggaaaacaaagtctggagagttatattctctgccggaactgatggatatggatgtacaacaggctctacgtgcctgtgaggatatgaaaaagatatgctcaagattgcagattataaaggatctgggactgggttatctgacattaggcgaagcaactccaaacttatccggtggagaggcacaaagactaaaacttgcatcggaaatggaacgcaaacaggatgcgtcggtgttcgtcttcgatgagccgacgattggtctgcatcctcttgatgtgcagactcttttgaaggtttttgaccgtctggtatccaagggtgcaacagtcattgtcattgagcatgatctggacgtgatccgcaatgctgattatatcattgatatgggaccaggaggcggagaagccggtggaagaatcattgcaaaaggaaccccggaggaaattgccagtgacagaggaagcataacggggaaatatcttcgatgatcagcattatgaaaagaccgacaatctcagaaagtgaggatgccggtcttttcctataattctaaaatctcttgaagctggaatctgccacaaagtttccggagattcttttccaccacgttttgcctaggtaatgagtgtgccagagatcatagatgaaagaagagtaggaaggcagtttgcttataataaaaaatgcggtaatgatatatatgacaaatcattggagtctgaaccaggtgtagtctttaaattcttttcagcttcccagcagtcaatgcgaagcatatagtctgcactggtataaacatcaatactgttacactgtggattgtattctgcaaatattgttctcatcgtatcttatctccttattgatcaataaatcatcagttacaaaaatcagaagcattttaatcagttcaccatgtcagttttattttgtgttatactgttttatatgatttttcttggtctccgctgccgcttcggtcggcacagagcagatgtccaccggacatcttgtgcccttgtattttcccttatcagagttcgtaagcactggcgggacgatgtaacacaagggaaacaataagggaaagttcacctgcgacaaatccagtgttttcaagtgtttgcagagaatttaataacaaaatataacagttattaaatctcttaaaacaggtgaaatctcaatcggaagttgaggaggtaaagagtgtatgaaaaagaaactgtgtattctggttattttaattgctgtgttattggtaggaacagtaggttgctatttcatgccaaaaaaattcggtaagaatgtaaatccttctgaggtagaccatataaatgtgttcgatggaaatacaggaactggttttactatcaccgattcagaagatatcgaatatatagtggcgaatattcaaggtatttcaatgaaaagagatggcatttcacttggaagaacaggatacagtttcaaaattagttatataaacagcaacgataaagatgtcatacctgtatttattctcaatagtgataatacaatttgtaaagatccatttttttatagatgtgatggcggattatgctttgattacttaaaagaatgtgaagagaaatatagaactaatgtaacagaatctatagaagaaaaataacatccagtttttgaaactaagaaatcggaattgaccgagctctttaaagcgagggacgcttcttgtccgaagggcaagaagatggagcatggaaagagttaaacaaatcgatatttatataggcattatagaatcagtctgtatgtggaggaaatcaaatgaactgggtaaatgtacagtataaaagtaatttgagaaaatacgaaaagaaggatggaatgaaagctcttgtaacatactgcttaataatgtgtagtgctttctttcaaggttggctttatacaacaaatgcaaatgtttttgttttaaatttatcgcagatattgattccattggttttaattgcagtattcttttgctttttttactgtagtaaagagaatattagaagtattggaattaattctgataatatcaaaaatagtatagtatttggtttagcgggaggtttcgtactacttgctatacagacggcattatatataatccaagggaaatcagtatcatttatcaatcctacattattaaattgggttatatttctatttgctgcttttgaagaagaaatactatttagagggtacatacagacaagactgtttggactcataaacggtcaatggattgttagtataattaattcagttctttttttatccatacattatcctgtaagatggatagtatctggagcaatatttatcaatgcattatcgacggtatacatagtatcgcttcttgtactacattttttttgcgatgctgtatataaaaggacaaattgcctatggggagcattcctgttacatgtaatctataatgcagtaggagcaatgattcaaatttcctaaagatggaacaatgcgataacttctggtttgtagaattaagaaaatcgggaatcaacaggacaaatgaaaggaataatattatggacgataatcaaaggatgaaaatcagaaatttcgggtatttaaaccaaggagcattaaaagggcaaattctttttacaggatcatccttgatggaaatgtttcctgtctgtgaaattgcacgaagccagggcatcgaacaagtgatatataatcgcggcgttagtggattgaatacagatgagtttctggaaaatatcgatacattgcttttagatcttgagccatcaaagatatttatcaatatcggcactaatgatattacaaaagaacgatttggagatcagtggatgtcacatttaatggataatatctgtagaatcatggaaattatcaaattccgtattccagatgtggaaatttttatcatggcgttttatcttgcaaatcttcacctgccatggcagacagaacaatcaatccaatggatgaaactccgtactcctgaaaatcttacattatgtaatcatcgattaaaagaaatagcagaaaaatacggttgtcgttatcttgattgtaatgaagcacttgttgatgaacatggtgaacagaaatcggagtatgccattgatggtgtacatatgtatgcaaatggatatttgaatgtttttaagtctttaaagccttatttgtaatgcatgaaagggttttattagtggaacaaaaagtaaacaaatcgttgtttatcaagctgtttaattttgaaaatttctttgaaaaactattgactcctacgtaacgtaatagtttagagtatgcttatcgagagaaggaaatgacaatgatgacggtgaatgaagtaagtaaattaacaggagtgagtatacgcactctgcagtattacgacaccattggactcttaaaacctattgaatatacagagtcaggttataggttgtatgacgatacatccttggaaaggctgcaacaaattttactgtttaaagaattggaatttccacttaaggagattaaaaagataatcgatgctcctaactttgacaggaacaaagcattagagcagcagattgcattgcttacgatgaaaaaggagcatcttgaaaatcttattagtttcgctcgaggaatcaaaggaataggagtgaaatatatggattttaaagtatttgatacaagaaagattgatgagtattctaaacgagcaaaagaacaatggggacaaacctctgagttcaaggagtttgaagagaaaacaaagaactggacgaaagatgacgaagctactgccgcaaatgagtttatgcaattatttgttgaatttggacaaatgaaggaaacaaacccggcagatgagcaggtgcagttgcaggtaaggaaacttcaggattacattacgaatcatttttatacatgttctgataagattttatgtggtcttggaagaatgtatgctggtggaggagaacttacggaaaatattgacaatgttggtggtacaggcactgcggagtttgcaagcaaagccatggatatattctatatgagcaggaaataaggaaaattttgccagagacaatgaagaagaaagcatgaaagctattctttataaagcgtttttatggcaaaacgagcatacagatatctgcaaaaacaataaaagtatttctggaataatattgtctctattaagtattcatggtacaatatccgaaaaatcggaattgtgaaagagtattgtaccatgaagatatatgaaaaaatatttgcaagacttaatgaactgcatatgagccagacagaactatccaaaagaaccggcattgctaccagtaccatcagtgactggcggaaaaagcagatcaatccccaggcagataaactatcggtaatatgtaaagcactggatatgtcccttgcggatttgctttgtgacaaagaaaatacagagcagacaacaccaacagattatttgattggtgataattatataatggaattattcagagaatccgacgccgataataagagaagaattcttaggtactttgaacttctggaaatctgcaatgaaatcaatgatagctgtccggcaaaaaagaggcagcgtaatgtatcaattattcaggatattgatgggaataacattgtagtgataaatgatatccgctttaaagggaaacggtcggttaactggaaagacgtaaaagagtatataaaagaatacgttggagatttttataaaatagcttctacgggagatgtgatatatattgggtctgatctccccagcgaatatagcggatcaaagtatacaaatagcctgaaaggagcaacctccaaggccaaggcaaatgctgcatccggcttaccggaaatgatagagattgctgtaggaaaacactttcgtataaatcaggaaatgaaacataagagagacgcaaaaaatggatggtacagatatgattccaggttcgcgcttcctgtgtatggaaatgacggggaaattgaaagatacaatgttttccatgcatctatgttaatacgtcattcaaatgacgagaaattgtatttgtacgacattatagatataaaaaaagaaacgagcaaccctctcggcgaataatcgcttaccagacaaaaaacccatttcctttatggatagataatactatatgatataaaaaatgtcaatccgaatattcgaaataatggtttggattagaaaccggtttttattctgcctgtcataaaatgaaaggtcattaaataaattccagttgatatttcacatattttaggaaatttaataactgttatatttgattatcaaattcttcgcaaacccttgaaaatactaagtttgtagcaagtgaactttcccttactctttcccttgtgttacattttcccattgcttttcatgaaccttaatatgggaaaaattaagggaaagaaaatttcataacacaatataacatataacaataacgacatggtgaactgattgaaatgttttcgatatttaactctgtaactgattatcaaaagaaaatggagataagatacgatgagaacaatttatgcagaatataatataaaccacgatagtattgatgtttacacaagtgctggatatatgcttcgcattgattgctgggaagctgaaaaaaatttaaaaaccacatatggatcagaatgtgcgcttacttcattggctgtggatgagcctttggaatatgcaagattatatcttgatggcaatttacagatgtgggtggatacagaagattcattagaactttattaagcaagaagtgagatagtgttgtagggagtttcctgtagttaaagataccacacccgatatgatgaacccacgcttatacactaccagctatgataaaagaaaggacagcaatttgacactgctgtcctttcttttataaaattgcagtacacagaaaaaagctgtaaaatgaaaaatatatttgtccttgtaacaattctcggacatttgcctgttatactatctgcaaaaagaaaaggaagtgataatatgaagcatattttaattgtcgaagatgataatcttttgaataaaacgcttacttataatttggaattggacggttacacaataacttctgttctgaatgcaaggacagccgctgaatcattaaaaacaaacatttttgatttggtattgctggatataaatttaccagacggaaatggttatgacctatgccgtcttatcaagccagagcatcctgatacagtagttatatttctaactgccaacgatcaggaaagcaatcagatacggggatatgaagctggtgcagtggattatatcacgaaacctttttcgattagtgctttgcagcgaaaaatcaaagccatgttcgctatgttggagcatcacaaaccagctaaggatatttacgaggatggtagcttgtttctggatttttcggaacaatttgcaagtttgaacgggaaaccattagcactttctgcgatggaatataaaatgttgaacctatttcttaaaaatccgaagcaggtacttactcgccaacaatttttagaaaaactgtgggatgttgatgaaaaatatgtagatgaacatacccttactacttctatcagccgtattcgcagtaagattgaagcggatggcgacacatatatcaaaacggtttatggtatggggtatcaatggacaggaggcgaaaagaaatgaatctgaataacctttctgctaagaaaatttgtagactggttagtgctggcatggttttctctatgctggtaattaccggtattttcggcggtataatgcaggatatacgaatttttatagtgggtggaacattgacactctgtgcgtttttctggatttggctattggtgctgatttttggaaaacgcctttctcattttacttctaatttgtgccggacgctggacaacatgattgatggaaacgaggaattacaaaagtcaaatgatagtgaaactctttttgcccgtatcaaccaccgcttaattcggttgtatgagattatgcagaaaaaccggcacaaggtagacatggaacgacaggagcttcaaatgctgatttctgatatttcacatcaagttaaaacgcctgtcagcaatttgcaaatggtaacggacacacttttaacaaagcctgtttcagaagaagaacggatggactttttacaaggcatacgtagtcagactgataaactggattttctgttccaagcactggttaaaacgtcccggttggaaaccggagcaatacgattagaaaagaaagacagcagcttattccatacgcttgcacaagccatgagcagtattgtatatgccgcagagaaaaaagaaattgctgtatccgtggattgcccggaaaatttgataatctcccatgacagcaagtggacaagcgaagcccttttcaatctgctggacaatgcagtaaaatacactccgtcaggtggaaagatttctgtatcagtggttcagtgggaaatgtacgtagaggtcaaagtgaccgacaccggcaagggcatttcagaaagcaatcaggctgccatcttccggcgcttctatcgtgaggaagaagtacacgatcaacagggtgtgggaataggtttgtatttggctcgtgagattgtaacaaggcaagggggctatatcaaggttgtttcagagctgaggcaaggctcagaattttctattatgcttcctgtaaggtaagatataaccactttttttgaaatgtccgagcgttgtaacatttcactctgattttcgataaaaattttttctatctcggacatttgtgtaacatttgtggtttacaatggctttatcaacagatagaaagccttgaaaggagcatttgaatatgagcattttacaaacaatcgacttaaagaagtattacggcacagaaccaaatattactcgtgcccttaatggtgtaaattttactgtggaacagggagaatttgttgccgtagttggaacttccggcagcggtaagtctacattgcttcacatgatgggaggacttgatacccccacttccggcagcgtgattgtacggggagaagaactcgcaaaaaagaatgatgatgaattgacaattttccgccgtcgtaacatcggatttatcttccaaaattataatctggttccgattttgaatgtatatgaaaatatcgtcctgcctgtggaactggatggcgatacagtagaccagaaatttatggacgaagttgtgtatatgttggctttagaagataaactggaaaatatgccgaacaatctttcaggcggtcaacagcaacgtgtagcgattgcacgagctttaattacgaagcctgcgattatccttgctgatgaaccgaccggaaatcttgatagcaagaccagtgcagatgtgttagggcttttgaagcataccagcggagaatttaatcagaccattgtaatgattactcacaacaacgagatcgctcaactcgcagaccgcattgtacggattgaagatggtaaaattgttggctaaaggaggtgggaattatgaattatccttttgaaaatgataccagtgcagtaattaaaaaattagcacgaaaaagtgtgcgttttgataagaagaaaaacttattttgcctttcggcaattattgtagccgttgctatgataatgatgtcgttgctcacagtgcaaaatatcatttatcaaaatcagaaagaaatcgaaggattacatcaagggattttctttgacattacgcaggacagtaaagaaaagttgttagcaaacgaagaagtaaaaagtgtaggactttcctgtaatatcaaaacagtgaaagaaaattctaaagaactgtctctgatttattatgatgatgacatgcttagtttgattcctgcctttgacggaaaatatccagagaaagcaagtgaaattgctgttacagatgccttttttgccagtgaaaataagtctccggaaatcaacgccatagttcagttgaatctggatggtactttgaagaattatactattgttggtatttatcatgataaaacttctaccgcttatcctgtttttgtttcacttgaaaaatgccgggaattacgtggaaataacctgcttaatggatatgtttggcttgaaaatgcagatacccttacaaaagacgaagcaacagaaatattatctcaaatttcagaggagactggactgaataattggacagtcagcagttactatgattatgtaaatacaactttgtccttcagtaattatgcggtatatggtgtagttgctgccattttgtttttagctgccgcacttgtaatttacagcattttctatatttcggttggacaaaaagttgctgagttcggacagcttcggacaataggggcaagtaaaaagcaaatttataaaatagttcttaaacagggttatatgcttgcagttccggggattttaattggtagtatcatgggaacgatcatcagctattgtctgcaatcaaaaggctggtcagtatttgcatttattgtttctctatgtggcgcatgcctttttggaatactgcttgtttatattagtgttcgtaaaccagcaaaaattgcagcgaatacttctccaatttccgccctgaaaaatccagtgggaattgtaaattaccgcactcacaaaagacatcgtattacgcctgtatatttagcgaaaatcagcttttccagaaacagaaaaaaatctctattgaccattttatcattgggactgtgcggagttatatttttccttgcagcaagttatcagagttcttttaatgccgagagtatggctcgttattgggatatgaagtacggagatttcaaaatcagcattgatttagaaaacgaaagtgaaaatttggatgctctcttgcagaaagaatatttttctgattatgtaaagcgtgttggagatatagagggagttagcaatatatttacttatgctaccgtaccagttgatttctcaacagacaatgatatttcagatagcaccttgatgctcggctataatgaaaaggatttggcgtcgctaaatgcagcggttttgtctggaaatattactgatgatacagaattagttgtaagtgatcccgaacgtatttatgatgtttaccattggaaacctcaaattggggatactgtgacctttaatttcaaaaatcatagtggtaaaacaataacaaaagcattcaaaattggtgcaatcacttccagcaatgatggaatgggtggctatattttcagaatgccggaaaatatgctcaaagaacttgcaggttatgactgtacatacgcaatcgaaatacaagcagaagctgaatatcaggagataatcgagcaagaactcaaattactcgtttctgacaatagggatgttcgcttacaaacccttcaagattttattgtagaacaccaatcagacaatcgtgcaggttttacattagcttatgcgattgcagccatcttgtggatatttgcggtcatcaatcaaatcaatcttactgtgacaaatcttttatcacagaaacaggaaatgggcacactaaaatctattggtatgacaaataagcagttgaagcaagcatttatgatggaaggtctttttactactttgattgcattgcttataactgctgttgttggaatccccggcggatatgcaatcggtatatttttgaaaaatgcaggcatgtctacgggatttgtatttccggttgttgcttttactctttttgctgttgctatgtttatgcttgaaagtttgatgacaatattgcttattcattcatggaagaagcaatctgttattgcaataatgcgaaattgatgatagaaagcttttcatatctcggtcagctccacaattacattactctgctgatacagccagtccgtaaattctttcgggctggctgttcctgtttttacagccttttttctctgtaatacttcttttcatacagtaaattttcactaggctggtatggagtaattttactgtctatacagtaagttgaaaatactaatatggtcttttttctaaccaaactttaagataacatctaattccaacatatgcgccctgcgaaagtacgaaaagcaatagaagatttactgacagtacttttttgattgattctccaaaataaatgacaatagcaacacttgtcagtatcattagtagagtaataacatcccaacagtttttcttatataattctataacctttatttctatcagtatcgccagcatccctgttcctgccatacatattcctacaatcaatattagcaataaccaatataccattccggctataaaagcatttggaatttttgtactaatctgtgccgcagaatgcccggcatcaatcgtccatccgacaaaggtttgtatgaatgatgctaaatcattgaagaatgatttacaatcgacaaggaacatatctgactgtactgcctgaaaaagagtggttgtcaacgaataccatgcaagaaggaacaaggttgtttggaacattaccgtttttgctttatactgtcctgcaagtcgctctttttgtgtttcgtattttgcttttgcattctgataggctgtccggttacaggcttcacatttttcatagagtaccggcttttctaccggtatttctacgattttctgatgtgtccgggcataatcccgttcctgtgttaaatagcatattttatcttgacattcctctatcatgacgtttgcgcttcgcaacttctctttctcgatccgcaatgctctgtctgccagcttcaagtcgttctttaatgcttgaatattcccggctctgttctctttgtttaatttctcgttcaaggtcagagattcgttgagctgcgtcttcagttccacgataagctggtctttctgttccaactcttcttgtatctcctcggtcaagagcagaagttcttccaactgttcggcgttctttaattctctggattcgttcatctatatcacgtcctttctctacctgctgttccagttcagcaattcggtgttctgtttcagtaataaactgttttcgctgttcagcttctgtgccaatatctgccattgctgattttcgttttccaaaagttctatcttcgttttctgttcttccatcttggaaagtagttcctcggtatttggcaaaatgttgagcagctcggataactcgctgtttaatttttgcaatttctgattctgttcctgcataagagagagttgggtgtcccggttctgcatttccagaagcatttctgccattaaggtctgctgttcttcgatttgcccaatcatggactccattaagggtataatttcccggctttcttctaatgtcatttaatcgctccttccataatgataatgcacctgatactttcccaaaggtgtccagtatcttttgcaataacgtgttttgttgttttatgatttgattttccgctactttccacgaaccttttatttcctgcccggcaagaaacttttgttcaatctttcttgcgtcagcaccttcatggatggtaggaatctggagttttccctgcttttcgtaagaacggtgatcgacctgattatgcaaaggcagatgttcattacacacctttgcccactcgctccgccacagttcacagttttttggattgttccatcccgtagcatcggtcagtacccgtttccattgcaggcggtttcttgcaccaatcttctggattccgttttcatctaatacagggatacggattccatgacggtcagggtttttcttatcctgccaccagttcggatgggattcatcaatcacgatatttccgcttttatctctgacaaaatcccaatctttgacttctttcttcccccaagaatgatccgggttaaaagggcgcattgtcagaagcagatggacatgaggattgccatcccctttgtcgtggatactccaatcagcacacattcccttatccacaaatgtttttttgatatagtcggctgtatattgaatctgttcctgtctgctccattctttggggagggcaaattcaaatgacctgccaagttgggcatctgcacttttttcaatcttcaatacctcattccataaccgttgtttctgaaatgtgattttaaatttttctaaagcagcttctttatcttctgaccttttgtatcggacagatttttgaaagcgttttatattttcttctggtactatctgccattcaggaggtgcgttttcgcacatcatcagactggtgtagaccacttcttttttagaagtgtaataactgattcgcccggtttcctcgtttttcatcacatccccattgagatatgcggaagcggagataacagatttccctttacttcgtccgactattttgattgtgtaatgaaaaatcgccatgtctggattccccctttctgcacatccggcatagatttccggcaacattgctttcagttttagaaaaagcagtattgccggaacgccctctgcgtaagagtgccctgcgcatagcagcctgcatggaatgcgcccctctggcgaagagtgcctcctgcggcatgagcaggtctggctgaaagccccgccgacggaacgagcccggcaagcgtgagcgaagaccggttgccacttgtggcaaacttattgggacgacctctggttgtccataagtgcgcccttcatgaaaaagcaatgaagggaatgaaaaactcatcccccccgccattacacttcctccatatcggtatgtgtttctttctgcattgcctttgaaaaaaatttcccattggcttcctgctttttcagaaaaccaatcagctttgggatgtcctcttcctcgataggcgcaccgagaacggattccaccgcaccgccaacctgacagagcctatgggttcgttttttactttcttcggctttctttcgtttcagaagttctttcttctgtgctgcatatcgttttgctttttcaaggctttcctgttccttcttttccatttcaagcattcgttcttcataactttttgttgattttgccatgattacattcccctttcttttacaaacataagttctcggttgcgtatcagaagaagcacatggtataatcttcttgcgtgtaggtatatcatggcttcggtctgatagaacctttggcggtttctttggaagccgcctttttaatttgccgcagttcttgttacggcttttacatttcctctatccctcaaatcacgaccttcattcgcttccataaacatttccagaatatcggttttaatcaggactttgcgaccaacctttaatactggaagtttcttccattctacaagctgtcttaaggtgtttctgccgattcccgtatagtcagcagcttcttcgatggataatgcaatttttctttgcgtcatataatcacctccttataaattgcattatgcaattcttgtgatgtaagtatatccttttcatatctttttgtcaagcgttacgaaatattaaaaataatttttaagttgcatattgcaattacagaaaaacaatgctataattcatacataccgaaaaaggaggcagtcagcatgaaagataaagaactacgcaagctgataggcagcagagtaaaacagcgccgtctggaattgaatctgacacagccttatgtcgcagaaaagatgggtgttaccgcttctacaatcctgcgttatgagaatggttcgattgacaatacgaaaaaaatggtgctggaaggtctttcggaagcactccatgtatctgtggaatggctcaaaggggaaacagatgaatatgaaaccgacattacggataagagagagttacagattcgtgatgcgatgggagatattctggaacagttaccgcttgcccttaccaaagaagaagatgctttttcaaaagatttattactgctgatgttaaaacaatatggtctgtttttggattccttccagttcgcctgcaaaaacttcaaggggaatgctggtcagacggatattgccaaaacaatagggtttgaatcgaatgatgaatataatgagattatgttcttaagggaaatcactcacaccatcaatgcttttaatgagatggcagacgttgtaaggctctattccaagaaaccaaaaacagcagaacaaaggcttgcaaatcttttatcagaagtcttatacgaagattccgaatcggtatagtaagacaaccggagttatgatatacttacacgcacgaagcatttcatcagttccgattgtctaatatcgaaaggagacatacgattatggcaaaaggatctgtaagaaaaaaaggaaagaaatggtactaccgcttctatgtagaggacgcaagcggcaatcttgttcagaaagaatgcgttggaacagaaagcaaaagtgaaactgaaaagctgctccgtcaggcaatggatgattatgagaaaaagaaatttgttgccaaagcggaaaatctcacagtcggacagcttttggatgtgtgggcagaggaggaattaaaaacaggtacgctcagcaatggtacggtggagaattacctcggaacaatccgaaatatcaagaaacacccattggcagaacggaaactgaaaaatgtaacctctgaacatttgcaatccttcttcgatttgctttccttcgggggagttcatcccgacggaaaagagagaaagggttacagcaaagattatatccattctttttccgcagtcatgcagcagtccttccgttttgcagtatttccaaagcagtatattacgttcaatcccatgcagtatattaaactgcggtatcagacggatgaagtggatttgttttccgatgaggatatggacggaaatgtccaaccaatttcacgagaagattatgaaagattgcttgcttatctgcaaaaaaagaacccagccgcaatacttccaatccagatagcctattatgccgggcttcgtattggagaagcctgcggtttggcatggcaggacgtaaatctggaagaacaatgccttaccataagacgcagcatccgatatgatggctcaaagcgcaaatatatcatcggaccaaccaagcggaaaaaagtaagggttgttgattttggagatacactggtagagattttccgtaatgcccggaaagagcagttaaaaaatcgaatgcagtacggagaactttatcacacgaactactacaaagaggtcaaagagaaaaacagagtgtactacgaatattattgtttagacagaacagaggaagtcccgacagattataaagaaatttctttcgtctgtttaagaccggatggttgtttggaacttccaactactttggggactgtttgcagaaaggtggcaaaaacattagagggatttgaaggctttcatttccaccagttacgtcacacctatacaagcaaccttttagcaaatggagctgccccaaaagatgtgcaggaattgttgggacactcagatgtcagtaccacaatgaacgtctatgctcactccacaagagatgcgaaacgaaaatcagttcggcttcttgataaagtggtgggcaatgactaaaaaatttcccttatttcccttgtgattatctcataagggcaaaaataagggaaactacatatcatttcactaatggacaggcgggaaagcctataaaatggggaaagttagaggaataattatataaattccagttgtagataatgcaaaaagaaaaattgaatttgtaaagaaatcagcaggagctgaaaaaaggaatcgagaaatcggttctttttttagtttgcgcgccatgggcgctctgacgggtgcaagtcccgaacgcgcccagatagtgggaagcgggtggcaggattatggggaaaacggtatttatgaatgcactttccgtgatattgaaaactcggctacaggcggcaaaaaatgaatatttctttaattttggaatcatactatttacattaatgaaagactaaggtaatcttttgaaaagtattcacagagtacgaataataagaaatgaggtagattgaagatgaagaaaaaaataattatgattgtggcttgcgtgatgtgctgtgctggattatttggcggctgtggacagtccgggatgaagcaggataatactgcaataagcaatagcgaagagggaaaacaggaaggaacaacagaagaaaaagaagtgaccggaacgattgatgagataaaagatttcatgtttgtcgttacagatgagaatgatacaccatatagctttacttttgaggaaaagccggaaggactggagaatgtcagcaacggagatactgtgactgtaagatataccggaacaatttcagaggtagatccgtttgagggagaggtaatatctgttgaaaaggcacaataaggccagaaaagcgactgaattactggcggttattatactcgcatctgcgatactgggagcctgtgcagaaaatgtacagaaacagaagatacctgccgcaacttatatgggcgggaaggcttccattaccgggatctgcagggaactggacgctgcaggagcttcccatgtagatttatttcaggagtgggtggtcgattttgcggattctgcggggaagaatgcaaagctggaggatgcctggtcagatcctgcgaagatgaaagcagatattgtaaaatgtatggatggctgggaacagaatcatgattattcagacgctgactgcaggatgacagcgttccttttgctggatgggatgctttgctcggagtcaacagaaagcaattatacaggcacatatttaatgtttgacacggaagcgatagataacgtggacagatatgaaatcataaaaaagaatagggatatgtttactacactctatggcgaaaagcgtgtaacagagggcaactctccggaaactgtgttttccgacagctggaaatatcatggatttcaaataaatagtgacaggatatctcttcttagtatcgtgatatatgacccgtattctgaggttgttttcgtagggcataccggcatactgataaagtacagtgactattatttatttgtagaaaagatcgcctttgaacagccctatcaggcgacaaaagtgcatactgtagatgaattgctcaatatcatgtcattaagagcggaatacttcggagaagagggggaagccggaccatttgtatataataatggagaatatattggaacgttaaagaaaaatattgacatggcagaaaaaataccctataatcgttctaaatagaacgattataggcggggttgagatgtatttctgggataaacataaaacaattacaggatattatgaactgttatccggcgaggtatgcgaccggtacgggttaacacagatggaatatgatatactgatgtttttacataacaatccacagcataataccgcagcagagattgtaaaggtgaggaaatcaacaaaatcccatgtatcaacttcactgaaaaaattggaaaatgaaggtctgattgaaagaatacaaagcgaagataataaaaagcatattgaaattgttttattagacaaggcagagttgattgtggaagccggaataaatgcacaaaaaaagttcgccaaaaatgtattaagcgggttgacagaagaagaaatacatatgtgtatcaatgtatttgataagatctgtaacaatgcagaagaacatttgagagactacagggagaatgcaaatgagaactaaattttgtgtaaagaaaaaacattactgttgattgcaggcattgtctggatgatagcaggagttatttttaccagaaattatttgttttacagccgattgatgaaaaaggggcaggactaacgatgaaagaaaacaattacaaaccacagatcccagatgtgatggaagcaatatttgatgcagcgtatttgacttttgatctggttgctgcaatgctttttttcatattttcaaagggaaatatgttatttattctttatggaatattaacattgacactttgcggaggggatgcttttcatctggtaccgagaattatcagggcagtacgtggaagtaatgataaaataaagcggcagctgggaatcggactgcaggtatcgtctgttacaatgacagtattttatattattttgatgtatatctggaagcttacatttccggaatttaaaataccggtggtaattgaagttgttgtatggatatcagcggttgtcagaattgtgatatgcctgttcccgcagaacaactggtgcacagatgaaggaaatatgagattatctattatcagaaatacagtttttgcagttactggtacagggataattattttatatttaatttcgggaaatacctatggatatcatatgacaaggatggctgcggctattattatttcatttggctgttatcttccagtaacgttattcagtaaaacaaaaccaaaagtaggactattaatgattccgaagacctgtgcatatatgtggattattgtaatgggactacagattttgtcggaatattaaaaatgagctgggaaatagcaaaatatctgatgtggctatgtagctggatttgtgataatttcagaaaagcacagaacaaaaagcttgcattttgaaaacaggcgtgtataataaagctgttataaaacagaccattacagaagtgataaggataatgaaaacggggtgctcgcacggcgggctgagagtaagcggatgctttaacccagaacctgatttggataatgccaacgtagggagataataagtcacaagagttatttgtgcaggaatctttgcgttgggttcctgcactttttttggccgtttgcgccgataaggcagcagtaagaaaaatgatatatcacagcggcagattgggggcaccaccttaggtcgctatataaaattaatgcagaggaggattttatgtacacagcattaacaatcgctggaagtgattccagtggaggcgccggcatccaggcagatattaagacaatgaccgccaactgcgtatacgcgatgagtgcggtcacggctttgactgcccagaatacgaccggcgtaacagatattatggaagtaactcccaaatttttggcagagcagctggacagtatttttacggatatttatccggatgcagtaaagaccggaatggtctcatccagtgaactgattgagacgattgcggacaaactgacagagtatcacgcaaaaaatattgtggtagatcctgtcatggtggcaacgagtggagcaaggcttatcagcgaggatgccatcggcacattgaaaagtaaattattgccccttgcaactgttatcactccgaatatcccggaagcagaagttctttccggaatggagattaaaacagaagcagatatggaaaaagcagcagaaatcatctgtaacaccttaggctgtgcagttttattaaagggaggacatcagttaaacgatgccaacgaccttcttttccagaaagaaaaagaaacggtatggtttcacgggaagagaattgacaaccccaatacccatggaacaggctgcacgctttcttcggcgattgcatcgaatcttgcaaagggaagggacttagaaacttccgtcaggtatgccaaaaattacatttccggcgcacttgccgccatgcttgaccttggaaaaggaagcggtcccatgaaccatgcatttgcagtcgaaggagagtacaaaggatgaataaaaagagaacttccgttttttcaaacggactaatctggtttggcgcaggcgtatctctggcggaaatactgacaggtacctattttgcaccgctcggtattggaaaagcaatggcagcaatcctgcttggtcatctgatcggcggtcttatgatgtttgcggcaggaatgatcggagcgaaagagcgcaaaagcgccatggaaactgtaaaaatgagcttcggcgagaagggaagccttctttttgccgtattaaatgtgttgcagcttgttggatggacggcgatcatgatctatgacggcgcacttgcagcggatggtgtgttacatattggaaactgggtgtgggcgctcgtcattggtgttctgattattgtctggattttcattgggctgaccaatctcggcaggctaaatacggttgccatgacagcactttttattttgtcactggtactatttaaagagatcttttttaattcagattttgtgatgctgattacagcaagtgatgacacaatgacgtttggtgcggcggtagaacttgcggtagcaatgccgctttcctggctgccgcttatcagcgattatacaagagaagcagaaaagccgtttgcagcaacacttgccagtgtgcttgtctacagtctggtcagcatttttatgtacatgatcggcatgggagcggctatttttaccggtgaatatgacattgcacagattatgttaaaaaccggttttggcgttgtcggacttcttattattgtattttccacggttacaaccacctttctggatgcttactccgcaggagtttccagtgtttccatttcttcaaagattcaggaaaaatgggcggcgatcgttgttaccgtgatcggaacggctgcagcgattgtgtatcccatggataacattacaaactttttatatctgatcggttctgtttttgctccgatgatcgcagtacagatcgcagattatttcattttaaagaaggcagatgccgaaaaatctgctttccagtggcgtaatctggtggtatggcttgccggttttatgatttaccgcatattgatgcaggtagatacaccggtcggaaatacactgccggatatggtgatcacagtcattctctgcctgattgtggaaaaagctgcgggggcatcacacaacaggaaaagaggatgaaaaatgaagaaactgaatttaaagaaattgacggtcacagcaatcttagcagcggtagcagtggtgggaagcttgttttccttcccggtattcggttccaaatgcgcaccggtacagcatctggtaaatgttttatgcgcggttaccgtaggaccatggtgggcgttggcacaggcttttattgcgtcgctgatccgtaatctgctgggactgggaagtccgctggcattcccgggaagcatgtgcggtgcattgcttggcggacttctttataagtacgggaagaaacttccgtttgcctatctcggcgaggtggcaggaaccggaatcattggcggaatgctttcttatccggtggcatatcttgtcatggggaataaagcagcggcgctatttacgtttgttgttccgttcctgattagtacctgcggtggaacactcattgctattattattacgctgccgctgaaaaaatcaggtctgcttggcagaatgaaggaaagtttagaagagtaaaaatgttaaggtgttgctgcatccgtattgcattgatgtatacgccggtcatggtatggagaagataggaaatatgcggttattgatcaaacagagagtgttttcgtggacagattcctatgacgtgtatgacgaggcggggagagcaccaggaagaggtcagtgcgtgggattgacaagcagatagaaattgacgtatactgaattggattttgaggaaaagaaaggaggacgcaggatgaacggtctgggttatgcaccggtctgcagcagcagtgcattgtcaaaaacagatatttttcgcgtgtacgggattactgcgcccttttttaagaaggtttagcgtttctgtacaaagaaaaatgcggcagtaattccgaaacagtttgatctcgcaaaggtgtgggatcgggctgttttttcattttattgataacaataaaaagaaaagaggaattacagatgaacgaaaaacagaatcttcgacttaagagaaatgttgggctggactatgtccatacgtttctttccaatatgaacatgcaaagctcgatctgggtgctgtatctcgcatattgcgggatgcacctggcacagatcggactactggagggaatttaccatgcgacaagcattgtgtgtgagattccttccggggctgcagccgatctgttgggcagaaaacgttgcatgattttgagcaacatctgcatcgcggtttcctgcgtgatcatgctgttctcaaaaagtttcgggtgttttgcggtaagctttgtcgtacaggcacttggaaataatttaaactccggctcggaggaagcgcttgtatatgacagcatgaagtgcctggggcaggaagaacactacatgggtgtctatggaagactcaatgtgctgatcgaagtggcgcaggggcttgcgacggtcgccggcggtgcgctggcagaattctcctatttctggtgctatgcggcatgtgttgtgattgcggtgctggcattgctgccggtactgtggatggcggagccgacgcagtgcggtgaggcagctgatacggccggggagggtgtggaagatgcggcggaaggaactccggcacagagaacgatccgggagaccgtgaagcatcattttgcagtcagtgcgtgtatcctgcaaaaggatgtcagaatcggaaaaatcatcggcttctattctgtcgtttttgcggcgcacacgctgctgtttttctacagccagcaatatttcgcggatctcggttacaataaagtgcagatcagtgttattatgctgctcgtgggaggcgcttcctgccttggtgctctcgtcagtgaaaaaatgtaccggtggtttgggaaaaagtgcctgataccggagacggttatcattgcgggggcaatactctgctacggagcagggaaggcgggcgtggcgatagcggctcttatgtgtgccggatttgcgaacgcggcgttgtatccgatccagtcggactccctgaacgcactgattccgtcagagcagagggcaaccttgatctcggtcgacagcatgtgcttttccatcgtcatgattgtgctgttcccgctggcgggagcacttgcagaccggtgggggttaaagacggttttactgttgctcggcgtcattttactactgtttcttttgacagtcttttgcatcgaaaaagaaagcttttcaagcgatcattcctgatgtatgatgaaaaaagcgaggtaagcatatgttaaaattagagaagggacgtcctgccgactgcgcgggacgtctggaaaaagaagtccggacgtacgattttctggataaactgaatatcgaatatgagcgcatcgaccacgaggcggcaatgacgatggaagagtgtgcagatgtcgacgaagcgctcggcgcaatgatctgcaagaatctgttcctgtgcaaccggcaggagacaacattttacctgctgatgataccgggagataagaagtttaagacaaaggatctgtcggcacagatccattcgtcgcgcctgtcttttgcaaaagagacgtatatggaggagtttttagacatcacgcccgggtcggtcagtgtgctcggtctgatgaacgacagggaacaccgtgtccagcttctggtggaccgggatgtgctgaaaggcgactacatcgggtgccatccgtgcatcaacacgtccagccttcgcataagacagaaagacatgtgggaaaaaattgttccggcgctggaacacgaaccggtctttgtgacattggaagaaccacaggagtgagcagatatgaaaaagaaaatgcagataaataagaagaaagaagaacggcggggaacgcaggaaaaaatgttggaaccggcaaagtcggcaaagtcggcaaaggcggcaaacacgggaaagcagacaaaatcggaaaaatcgtcgaaaccggcaaaatcgtcgagaccggcaaaactgaataagccggcggagcgcgcagatgcggtctgtccttacgcgaagaaatgcggtggatgtgactatcaaggcatgccgtatgagaagcagctcaaggagaagcaggcatatgtgcaaaagcaggtcggatcattctgcaaagtgctgccgattctggggatggacgagccgtatcattatcggaacaaggtgcacgccgtatttgatattgaaaaaaagcgtggcagtcgtcccggcgttcgtgggaacggtaaagccgcaaacggaaaacagggaaacggcaaaaagggaagattagcggcaaagccggcaccgggagggatcatttcgggtgtatacaaagcgggaacgcatgaggtcatcaatatcgatgcctgtcagatcgaggatgagctgtccggcgcgatcatccgtgatatccgggggcttttgcattcttttaaaattaagacatacgatgaggacaccggttacggtctgctgcgccatgtgctggtgcgccgcgggttccacagcggggaggtgatggttgtcctggtgcttggctcgccggtactgccatcgaagaatcattttgtgatggcgctgcgggaacttcacccggagatttcgaccgtgatcgtcaacgtgaacgacaagcgcaccagcatggtgctgggcgacaaggagagtgtgatctacggtaagggctacattgaggatacgctctgtggatgcaccttccgcatttcgccgaagtcgttttaccaggtcaatccggtgcagacagagctcctctacggaaaagccattgcatatgcggcgctgaccggaaacgagacggttgtggatgcgtactgcggcaccggcacgattggcattattgccgcgaaatcagcgaagaaagtgatcggtgtagaattaaaccgcgatgccgtgcgcgatgcggtgaaaaatgcgaagtgtaacaacgtcaaaaatatcgaattttacaacgcagacgcgggacagttcatggtagagatggcggaataccgcgcggatgcgaagcgcggagagaagagcggagcagacgaggtggatgtcgtcttcatggatccgccgcgcgccggaagcgatgaggcgttcctctcctcggtggtgacgctggcaccgaagcgtgtcgtttacgtttcctgcaatccggagacgctggcgcgggatcttttgtatctcacaaagcatggctaccgggcacaggagtgccagccggtggatatgttcccgtggacgaaacacgttgagacagttgttcttttgtcccaacagaagccggatgacacgatagagatcgacttagacctggacgagctggatgctaccagtgccgagttgaaagcaacctatcaggaaatcaaagattatgtgctgaaagaatttggcttgaaggtttcaagtttatatatttctcaggtaaaacgcaaatgtggaattgaagtgggagaaaactataatcttccaaaatcagaaaatgcaagagttccacaatgcccgaaagagaaggaagaagctatcaaggctgccctgaaatattttgcgatgatctaaggacatcgctgatttcaaggaggaataacacatgaaaagcacatttgaaaaaatgggtggaacctacacacttggcgcagacggaatttactatccgaatcttgtcagtacagatgaagaaccgcattatgggaaatatggaatgatgcggaaaacatatctgaaagagcatcgtctggcaatgtattcactgtatatgttggaagacagactggtggaacatctgaatcttgtggacgatgaagcacaggagagaatggatattctggtacgtcagatgatggagcagcagggcattacggaagaattgaaagctcgtgatcagatggaatgggtcagagcggtaaacaatatccggaatgctgcagaagagattgtgttaaaagaattagtgtatatttaaggtaatggaaagctccttcgggagcttttcgctgtttggaagagattatatagaaaatgggttaagaagatggtattattaaagcaacgggatttttttattatagtatctaaaatgttttattcattacaaggaaatggaattgatgaatgccattaaacttcctaatagaaatagaatcgttcgatattctgaattggaaaatttgataagtacagattagagcacgtgtagatgtaataagagaacgaaaggaaaaatatgggaaaaagcacaaagaagaaaaacaaaaagattacagctccaaaagcaaatattcaggaattaagtatttctagggatggcggacaaattgcactcagggggtattcatatcaatttttgtattcgtgttatttaattctttcgtcatcaaatccaagcaattttttccagcttgaggggattgaagatattgattgtatcatgcagaaaaatggtagtaatgatattactcatatacagttgaaatattctgtcaacaaacaggatgccagctttttaactgatgtgctcaaaaattttcttgaagcatatttgctggatcaaaatagattttttaagcttgtttacgatttccctgttgcaaaaggccatctaagtaagatatttgcatctaagttagacgaaaaatcacgcacccattgggctggcgtgatttcaaatatcaagaaaaacaatccttcttggaattggtctgtttatgatttcgataaatttatttcacatctgtcatttgagaagattgaaaaatctatacttgctactgaaattgaaaaaaccttaattagaatttatgagattaacacagacaatgtttcattatttgcaaatagcataaaaattctttgctttgaaaaaatggagcagcgggcctatgtgacaaaagcagaattagattccaaaatccaatctgtcaaaatagatatcagtaagggtcctcaaaatccagctcatagttggattcgtaaactggactactctaagcctagcattgatgaagggtgtagtttttacgaagggaaaaaagcaacaccagcagatatagtaagtgggtttccaatcaaacgaccgagtttagaaaaagatgttattaattctatttgcgaaaacatggttactgtaattaaagcttctagtgggcaaggaaaaaccacgctggctttgcgggcagcttatattctccaaaatgaatatataccatatcagttactatggtgtgatgagataaaagaaattgggaatattgtccaatatttcaaagcaagaattcagcttggtgaaaagattcttatcttaattgacaatctggataaccatctcagcaaatggaattatcttgttcagctcttacaatccgaattgcattgtcattataagttgctcatcacatcgcgagagatggattggtataattatagtggtgacttgagcaatatccagtctttgaaagtaattaagccggttttagaagaaaaggaagcaatagagatattcaatctattcagagaggctaagcaacttcacccaagcataacaagctggcaaagagcatggaataagattgcagaaaggcaactacttatagagtatgtctacttgcttactcatggtgagatgttatcagaaagaatagcctcacaaatatccgaaataggacaatcatcttctggcaaagcaaaatgtgaaatcttacgcaaagtatgttttgcagatctttgcggagtcaggctttctgctatcaaactttctgcgagtcaatcagaagactctggctcggattttggggagcttttaaaaggtatggaatcggagttccttgtgcatgtaaatgaagagagtgggtatattgaggggctacatcccattcggtcaaagcacgttgttaagaggctgcatgaattcctgccaattgacaataccgccatttcagttatgaaaatggcggacaaagcggacctatcgatactgttttctcatctgccggagtttaccctgaacaaagaaacgtttttccgcgatgcggtcgagagtctatgggatgaaaaagacctttcaaactatacttctgcaatacaggggcttttttcagggagtgtgatgcagtatttcctttctaaccgggctgcgtttgacgatgcagatgcccacggcggtctttttcttctatcgaccgaaatgtgcccctttgctgtattcgaggatttcggtgtgtcgatggatacgctggacaaaatgcgggaaacatttccggataataagaatatagaatatctttgccgattacgggagcgtattcccacctgctgtttgcaggaaacgtatgtctatattttctgcgattgtttatataggaaaatgcgcacctttcgttttgacggaataaaggacatcacgtcctatacctccatttctgagtggatctataacatcaatccagagtggaatgtatcggccggattttctctggacgatctttggagcaagccagaaaaattgacgctggagtgcgtttctacgctgatgtatctctcctactgcgggaacagagagaaatatatggaatttgtggaacgaaatcttaagagtattcttacgtaccttaagcagtggaccagatcacatagggtatttattgattccgaaaaaaaagcgattcacattgaatatatccttcgattgcacaatattaaaacgggaaatgagcagagcgtctcaaggctgaaattcctttgtaaagccttgcctatttttgatttgtattgcgcggatgctctcaagccgacagttgatttgctctcggcttatcctgttcccgacgatgcacataaagaaatgcccattaaaaatattgtaatcatgttccatcagaatcttacgtcgctatggaacaagaccattatgagcaattacgaatttgataccgcgacagaatggttaaattactggtttgatgtgagagaacatatatgtttgcttgcagataagtgctgtgcctgtatttacaaactccttggcggaaaaccattagggagtttggccggggaggtagatcaacttcgtgaagaatttgccctaattactactggtgaaaagcgatatcctaaagaagatcgtccttttgaagaaaaagctacagtgcccgagaggttaggaaaaataaagagtaaatactttcaaagcatacaaaactttatgaatcagtttgcagggttcctcattaagaatgaacaaaaacaaagattggctatggttaacctcacaatagctcaaagtgctcttgtgacaatgcagaattactttgcagaaattgcaattgattttagctttcaggaaagacagttgactatttgtgttatggaaacacaaaacatagagcgactaataatgtgctgtagctactaccagacacattcgccaaataagtattttaataaatatcaaattagcaattggtatgacgggcattgtcgggatgagagaaagatagtagaagacggattgtcggaattagaatcaaagtattcgattcattttcctgatcagatttacaccattgacatgttgagctattatcccatcatagttggtaattttgatatggcatcggaaagcaatttaaccgaatggcttctgggctgtatcgcatttgctgatgctccctttgattacctagtcatattatctgcaaacgagtccaaagaaatagattctactgctttacagttccctcgacggatgctcgttgacgtcaagaaggcaatcgaatcagaaaatcattcattgcttgataaactggtgcctccatatcctgtgaatgtgacagcacaaatgcttgactgctttagtgaaaaatatgatttgcctgaaaaaaaagtcaccgatgtcgatgaacttccaataggatatattgcagaagaactatggatatattctaaatctgtggagttgttgacggaaccagaagatgcgtgttatcttgcagctcaaacgcaagatattcagctcaacattacggaaatgctttgtttattgaagaacaagcttccggtcaaagatgtcgattggttaatagaaatttgtgataacgtattttcaggagaaaaatttgatgacattatgttcaataatgttattgaacatttcatacagaaaaagattgaacagtaaaatcgttgtagcttgattgttttagcagacagtgtctatttaatcgaagaaaaagaatgttgatagtataggcattgaaaatgctagactatgacttagatttcaaataaaagtaaatagttggaatattaaaataataatgtgtgaatattattcattgtctcggcaccatttatggtgccaggacaatactttagatgattacaattccatatcatgtgaccttttcttagtccgagcagactgatttcgccgcatttcctgttctctctgatatttaagttcccatgcacgatgggagaaaacatcaggatcctccacattgagataatccacctcattggcggcaatatcacgacggtgatagtcgtaatatttaccgaaagtacctttgagttgttcaatcagcttatcccgaaaatcaggacgtatctggattctggtatccagcaattctgtgtactgttctggttcaggacgaaatttttcttcccggaaagcggcggcatctttttcaagctgttttttgagcgagatgtcctgagaatccaggatatccagattgttattcatctggtcatattttttggatagattcgtcatatctttatcggtagagcattctgcttggaagattagctgctctttccttgatttcagttcttcgatttcttcggtaatagtggtaagctgctgattcaattttatatgctggatgggattcaaaatactggttttctcttttttcacattcagttctttccgctctgtaactttagctttgagtttctttttaacggtgttgtatttattcagtattggattaaaatgattcatccagtcatggatcacttctttttgcatctcattgtggagcaaatgatattgtgtaaaaatcatgtgatttcggattgcttccaatgtttctgcaattattggaatagacttttctacagcttcagccagttttgctacttttgcttttaattctcggagcattttgttatccgcacgaatctgacggttgatttcacagcggtctgctatcatgcctttcttttccatattctgggcaatgtagccttcatggatggttggctgttcggtgattccctgatctgcaaagctgcggtgatcaatggtagcatttatctgattacgtgcaagcatttcatttacggcatctgcccagtttgcccgccagatgcaaagttgttcatcactgttccattgttcggaaataggattctgtctgccatatcggctgctcttggggtgtttatcattccgttcatatcctttttcctgtgcaacagaggaagtcagatattctttctttttcccaactttatagcgatattgcttttcccatccctgtttctgagcagttttaaattcagaagcagtaaatcctttttcttctccatctttgatacagagatattctttttcggttttatactgccatgttccattttcatttagtggtcggacagtaagaagaatgtgtgcatggggattgtgaccatctgtattgtgaatggcaaaatcagcacacatccccatatctacaaaattctttttaataaaatcctgaagaagagaaatattgctgtctttatccaactcaacggggagtgcgacaacaaattctcttgcaagtcggctgtctttggtcttttcgttttcttccacagcattccagagttgttcccggtcattccattccaatggagccattggaggaagcatcacctcctgatagatcagcccctgctttctggtatagtcatgctggatgccgtcataatcattgtacatgcggctacagctcatataagcagaagcagcaacagcagatcgaccggaaccacggctgacgactttggcttgcatatgataaattgccatatctggcacctcctttcgatgttgcctgcaacagcggataaagccctcggcagagcgcacgagccccgaaggggataccactgcctgatttatcaggtggtgagtaagtgcgcccttcgggagtggaacttgtgcgtttacattccccgtagccggatcatcagctcccgtttcagggaatctaaatccatttctttaatatggggaacaatactttccagaattgctccttcctggactaacctgtgtgttctggcatcacgttcttttttgcgatttcttgcttcggcttcttcctggcggtgtcttgcctgtaaaagtgctttttcttccggtgtcatgatttttttatctgccatatctggcacctcctttttatgcccgtatccgggcagttttggttttaaaatcttttggtttggtactatggttttagataactgacagtgacatatttccggtaataaatgaggaaagaaagtagtaccactgtcagtgaaaagtaatcattgtgttatactttttcgagtcaattctggttcggagcatgattgttcaacaggatttttttcgcctgttttaaattagctgttgcattgtcctgacgaatattccggttattgatacggacaggaatacatctctccagaatacggtcataaattcgtttgtgtgcgatatcagcggcgttattcagttctgataaagtgagattggtcgttatgatcaggggctttttactgcggtaacgactgtcgatcacattgaatacctgttccagtgcaaagtcagagttccgctcaattccgagatcatcaataatcagaagactgtagcggtttaagctgttgatgaactggtttctgtcttcaaaatgcattccggtaagggtattcagaattcgggaaaagttggtcatcagtacaggaacgcctttttccagaagggcattggcaatgcagcctgcaaaaaaagattttccagtaccgacatcaccccagatgagaagtccggaagcgtttgctttcatctcttcccagttgcttacataattgtgtgccagttttatttccggattgatgccgttatccctggcaaaagtgtagtcatagagtgctttgtcctgtaagccgctggttttaagatgctctatttccatttgtttttcatgaagttttctctgggcttcttcctgctcaaagatttcctgctggcatttacagcggatggaaggaataagaacctttccctgtaatttatgcctgcattgccttggcgtattgcatttagaacagtagatcaggtggtctgtttcgttaaaatattcatcaggctgaagctctctgtttggtgttatagcggttgcttttcctgtaaatcttgtcatagtgtttcgtattcctcactttcgtaatttctttgccgggaagcaggatgatcctgtcttgcccaactgatgatggtagctgcatggttctgatattgttttccggtagaagccatataaccggataagcgttcaatataatctttccagtcagggattgtctgccggatatcttcaagctctttttctgacagaaaaacattttgaaattttccatagggtgagagtggctccttactccctcttattgctaaattgttcttttttatctctttcttattaccagacagttttctgtctgtatcagggaaagaatcctgtctgtcaataggacagttttctgtctgtcttagggaaagaaatctgtctgtatagtggatggtttcttttgggagttttacataaattcgattgggctgtccgggtccctgccgttttcggaagataagctcctgtttttccagtactgccagagcagttttaatcgtcatctggcttttgtggagaacttctgccagtgcttcaattgtaaagtaaatgaacacatgaccatcgatatctgaccagccctcatttttctgggaaagccttgcccggtcgagcaggataatataaagcattttggcagtttcgtttatttccatgtccagaaggaaacggggaaacatcatataagatggcaggttggtgtctgctgtcagaaagtccgtcatgtgttcacctccaatcagttattctccaagaaaatcccagtctacatcattatccggctgtgaattttcaggtgttggaaaggacgccctgatttggggctccctttgcgccatgcctacagtcagtccggaaagaaaaagtggcaattcctgtttcagactgttttccactgcatctacaatctgtttcacaaaaagttcttcccgttctcttgtttccagataagaatcagcctgtgtgcggtagtagcggtcaaaataatctaccagtgcaagagagattacctgactgtaagatttaaaatcctgcctgtccatcgtctgtaaatattcccaggctctccgctgttgttctttgtccagattaaagcgcaggtttgtgttgcggatattgttctgcatggtttatcccctccttttcaggctcatataagccagagattcgtaacctttggcagtggcgcagatgtcatcaatgattgtgactcgtgatttgtcatacgttccgaagttacggatcaggcatccaccgccgccaaccacatacaggcgcatcaggtcaggattatattcatatttgcggagcgtggaaaaaagttctgccacatactgtctggcaatagaactgatacaatccagatatggtgctgaaatgtcagctgttccaaaccgcagaatctgttctactgtggattcttcaattttcactccgaatttgtccagaacagcgttctttgcggcaatcatgcactggtttacaccaagtttttctgtccagcatcggctctcctgagctttcttattgttaatatacagaatgttcatggttccgtttccgatatctgcaaggagattagttcccttgaaattttcaaggtggtttacaatagccggatatccctgtgggtaaaggctacatcccgcaaagtggagatgatattctttgccgttgaaacggtaatggacttctggattctggagcagataggaacgaaaagcttctctttgatttctgatccatgtcagaggaagtccggcagccagatgaacatctgcttcacggatggaaaagacattcagttcccttgcaatagccattagcgtcagaagataatattcttcgtccatagctttatccgggataaattctttgtgtccttcgccaatccggtagtaaatgccgttatattccagaatattcccggtgaagattggttcggtttcataggctttgattccggttggtgtgacggtgtttgctgttttcatattgccatagccatgatctacagcgatgatttttgtgtttttgagttctcgcataaaaaatacctccgttttcgtattgattgattcagcaggtcataccggtgtggtactgctttgctgtgagataagcatacgaaaatcggaggtaaaagacattgagtggaaattgagctggaattgagaaaaaagatatattgtgcgtacattcttcatgtactcttgttgtgatttcattgttttttatcgtataatatggatactggaggtggtttggatgaaatacaagattttagttgtcgatgatgataaagaattggtgaaaatgctttgtagttattttaatatgaaacaatatgaaaccattacggctacagacggaatggaagcattaaataaaataaaaatgaaaccggatattattttattggatatcaacatgccacgtatggatgggattgaagtatgtcgtctgatacgcagtaaagtgttatgtccgattttgtttctaacagcaagagttgatgaagatgataaaattaatgggttgctttcgggtggggatgattatattacgaaaccatttagtcttcgggagttggaagcaaggattgtcacaaacataaagagagaagaaaggcatcaacaaaaaacggaataccgtttcatggatgaaatgctgattgattattctgaaaaaatagtagctatagctggacacaggatggagttcacaaaaattgaatatcagattattgaattcttatccatgcatccggggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtatgggggattggataccgatggaaaaaataagaaacttgtcactgaaaaaaacaattctgctttattttgtgatcagcttaacggcagcatttctgttatctggatttacagttcattttgcaagaaatatgcagaataaaatatgggaaaaatatattgattatgcagattatacggacgtgtttcagcaatatggaaagaaatacgagattgagatatcaagacctaatcaatcgcagatgaatcgtttggactatcatctttcggaaatgtgtgactttatggaaacatattcggtactgattttttcgattgttgggagtgttgctgcggtattccttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgatttagcagataacaacagaaagatgtggcgaatgattgatgacgagaaggctttgcggaatgcaattgcacatgatatacgttctccactttccatattgcgtgggtatcaggaaatgctcttagagtttgtttctgctgagagtataaaaacagaggatgttattgatatcttacaaacaggcatgtatcagattgaccgtatagagcatttcacggaaaacatgagaaaaatgtcccatttagaacagagggaactgcaatgctcagagatagaattatcggaactggcaaaaaagattgaggcagaagctgccatgctgtccaagaaggaaagtaaattatgtaaggtagaaagagcgcaggaacaaaacattgtgaaagtggatgaggaacttgtcatggaagtgacagacaatttactggaaaatgcggttcgatatgcacaaaaaagtattgctttgcagataaagaaaaaggatggttttcttataatttctgttgaagatgatggaataggatttgtggatactgaggaaaaagtaacagagccattttatcataagaatccacaagatgatttaaagcattttggccttggtatgtatatttctcgtattttctgtgaaaagcatggaggaaatttgaaaatatataatgccagacaaggcggtgctcatgtagaagctcttttcaaagctgaataaaaatactttataaggctgaaatcacaaataaagtggttttagtcttttttgttgtgaatttattgagaattgatttgtatgatgttgttaaagaaataaagaaaggaagagatacaatgaaaacaatcataaaaagaagtatacttgattatttaaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcaatccaatatatatgtgggaaagtaataagcggattcattagtatgctgggagtattagtgattttgaatgttatattctttatgctgtgtttgaaaacgtctttagaatcgggctttccagtaacaccaattgatttttgcgtgaattctctgatctatattgttccgaatcttttgatgatatgttgtgtctatacaattacagcattaatatttaaaaatccgcttccggcagcaccaatcttgtttttacacattatatattcaaatatgctgaccatgaagaatgatatttattatatgagaccgttctctattatggtgcgattccctggcagattttttgaaacacatgtagccaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtcgccaatagcatttttaacaattattttttgtagtgacacatatttgatggaagtaaaaagtaagcgtgccgatgtatttcatttgtatgatcaaaaaaagcagttaaaagtaatatcgcagagagtgggcgttcaaatattatatttattaatactttcctgtgttggatatgttttgtttttctggcaaaaaccgggcagtgtaaacgaaggcatttcgggtattcagatatttcttttatatttcattgcaatgtttggaactatctggctttggagtatatgctctgtgattttgtgtacattgcttcgaaatatgtgggcaggtattggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagcggggctgtttttatttgcagtattaccaatgactttaaagaaaagaggatagattatgagtattagaataaatgatttaacagttagatttaaaaatggtgtagttgcagtaaataaggcatctcttgaaatacctaagggaatttacggacttttgggtgagaatggtgccggaaaaaccactttgatgagggttcttacaactgttttaaaacaaacggaaggaatggtttcccttgatggaattctgtataacgagggaaattatgagaaaatacagaaaaagattggttatcttccacaggaaatcgacttatatccgaatcttacggtgaaagaatgtcttgtatatatggggggactgtcaggagtagccagaaatgacctcgaacaaagaattacctattatctggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaacgcagaagaagcccgtttgttagaagccaattattctatatcatctaagcagtatgtagaaaatggaattcatatgaaagtattaagcaaaggaaagccaaatgagaattgtgtcctggataatgatatcactttggaagatgcatatatttatttgacgaatagttgaatataacggcgggcaagttgcccgccgtaaattatgcttattttgttaaaagaccggatagattttttccaatgcaaaatccaatctgtggatataactcctgaatttcctgatattttgctccaatcatttctggttcatcagcccagatcttttcatatattttgaaagctcttttaaaatgtgttttggcttgcggaagattggcagtcatcagataaatggttccaagggtttcctgtactttggcataatccagacagtcatcggaatggtattccttgatgatgccggataatttttgcaattcagagatgcctctttcgggttcctgctgttctgtcaggaacattgcataattggcaatctgaggtatgctgtcatttatatgaagcaggttaaattggtcaagcagtgagatacttttttccatgtgttctcttgcaagatcgggatgaccgttcatgcggtaaagtccaccgagattggcatgaaggttggaaacaaggcgagcattgtcagcagtgatattttctatctgggcaagtgcatccttttccagttttattgctttttctggcttgatttcaagagtagcctgaaaatccagtaacaatgcccggtcagaatcggtgccaatgtctttacgcttcaaaaaatttttcaattcctgaatgattgctttcatacctttctggtaattataattatccatatatggaaaaacattttccagaaaaagtagatattttggtatatcatctttttcaatcaattctatgatgtttcctgctgtctgaaacagcttcttgtaataatcgacttcaattccatgcattaaacatattttctgtaaagaatccagtaatatgtgacagctacttacagatggttttgtctctgaaagggtgatttcctgaatcatcggatgcagagagatggtgcgacgtgttgttgtctgaacgaaaccagtctcaattaaatcgttgatttcatttagtgtgggcatttccagccatttggcaaatatacgggcagaaataccggtggaaggaagaaagcacatattacacatgatatcctgctgttcaagagataaagtgtataaagaaaacagcgtatggatatgactgtaataggtggctttgctgctttgtccatctttgattattttaattttatcttcgttatggaaagatgctttttccacctgaagtcttgttaataactggtctggagttgagattccattttccagaagttttgctgccagttccacggcaaaagtatgagagtgaacagtttcgatgatcttttcaactgttgcccggtacgtgtctgcctctgaataaaatactgatgccagctggaagagagcgttcatatcctctatttcttttaatggcagagtacagtattcatccagtttgcttcgggttgtaaacaaaatctggcagcgatattttaatactactgacagaaagctgtcctgtgtcgcagtgacattaaaattatctatgataagcagagtatcagatttcagggaacgcagaaaacggttatgtctttgaaaccgttcctggtcagtgctttccggcggatcgtcaataaaatccatgtcagtaatatcctgatgaagattgccggtatattctatataaagtatattggtgtattgctttatgtaccgctttgcgtaggctttggcaagttcactttttccgattccggcgattccgcaaaggaaaacatgacggttttcctcaagcacggtatataattcttccagttctttatctcttccgataaaatgacggcatggtttcggaacctcactgtccataatataatccagcacaatgggggataaagcgcctccggcgagcagcttctgatttttggtattacgtttgatgaattggcgttccatgccaaaagaaatcagttttgcaagaaacagcagtcttgaactggctggtttatataagggagtcagatttttcttttttgcatctgagatgctgtcatcctgaatgaataaagtgtaaatatcttgtatagccatattacagtcagacatcagtggaagaagattctggtggatggtatgggctaatttttcctgattggatggcttggaatagtaagcggatattttaggactgattttagcctgaccagtcatccagcggcaaaccagaccgttgtccattgaaaaatcctgatttaccggatcatccataaaatcttcaaataattcgtataaaaaatcaggctgactcatttgattactttcgctgatatgattttttaagcaagtgctaatagaagaaaaatcgcatcgattcaatagaaattcccctttcgtagttaagattaagtatatctatcataacacgaacatatattcgattcaagaaaatgcggatatttttaaattgattgtgtcaatttacaatcaatttctattcaatgtggttttccggcaggttctgtaaaataagctcagatcaaaacaataacgggaggagcttatgcaacagaatattgaatttgagcggtgcattgattttctggtacggatgattgataagtacggcgctgaagtcctccgggagttggaggaaaaaaaacagaataaggaagaaaaagaagcggcagtttcctgaaatacaaaatgtaaatcagactgtcgcttttttcatgcatttttaaatcaaataaattttaaaagctgatgcagagtgtgtggctcattattctgagaagcggtaatacgcgtatcaaatggcttgaaatgattctgcgtataaaagctcagaagaaattcattatcttcgcattcaagaaactccataacgccacctacggaatatttgagactggatatggtttccagtgcaaatcccagtagaatatttccaggaattcgtttttcctttggaagagaatagttctttcccaactgggcgatcaggtaagctgcggtagtataggattgtgtttcttcatccaaaatactgacacgggacagtttttttgccattgtcttgctgatatttgaagcacggacagagattggttttattgtaagtgaaaaataaccaaccagtgaagcatcttcagcatcaaataccagataagtgatagattgatcttttttggtaaactcaatcgcattatgtaataaaaagtattccacatcgggatttttgggacaagaaaaatcggagagtaagtcgtaaagactttcctctccgatatatgtcggttcgtctttatccaaatatgcccgaatattaacggtaaaatatttatcagacatgttttttcttcctttttgacattaaagctaagatttcctgtgggttcgttaactgacgtccgggaagtgtctgctttggtgtgcggtcacggtcggcttcgtcaattgctgcgacaaaacgctttacgctatttggattggatacgacaaaattatgagtaatacttgaagtagccatactaacacctcctcttttttggcttttttgtgtatttatagtatatgcaatgtgtgataaaaacacaatatcaaaaacagaaattatttctaaataattttcaagccggacatttattagacgcttccggtaagcgaacaatattttcgagccaatcatttataagtcgccaatggtgggcgggcaatattttgataacagaaatgctctgtatctaacttaattatacgattggcgaagaaatgcgtcaatacggaaaataagtattgaaaatagttggaacaagtactaaaataaggttgggacaataaaacagagttatactgcgaggaagattatgaagaataaaaagattaaatgcgatatatataccagagtatccacaaccatgcaggtagatggctacagtctggatgctcagaaagaaaaactcaagagatatgcggaatttcagaatatggaaattgtaaatgagtattccgatgaaggtaagtctggaaagagcgtagagggcagaccggaatttcagagaatgttggataatattgagaatggaacagatgaggtacagtttgtattggtgttcaagctttccagattcggtcgtaatgcggcagatgtattaaattctttgcagaggatgcaggattttggagtgaatctgatttgtgtagaagatggaattgacagctcaaaagatagtggaaagctgatgatttctgttctgtctgcggtggcagagattgaacgagagaatatccttgttcagacaatggaaggacgtaagcagaaagccagggaaggaaaatggaacggaggattcgctccatatggttatgaattggtaaatggagaattacagattgcagaggacgaagcggagattatccgtctgatttatgacaaatttattcatacaaatatgggaatctctgcgattgctgcatggctgaaccagcatggatataaaaagaaaaaacgacagaataatacactggacgcatttgcctcttcctttataaaaggcgttctggataatccggtatactgtggaaagctggcttatggacgaagaaaaaacgagaaagtttctggtacaagaaatgaatatcgcattgtaaaacaggaaaattatatgctgcatgatggtatccacgaagggattatttcagaaacagattgggagctggcacatcaaaaacgggaaaaaacaggtgtgaaatatgaaaaaacgcatagtctggatcatgagcatatcttatctggaatattgagatgtccgttatgtggaagcggtatgtatgggaacgtgaaccgaaagaaaaagaaagacggaaccttatataaagattatttctattatgcctgtaaacatcgtcgtctggtagacggtcataaatgtggatatcgtaaacaatggagcgaggagaagattaacaatgcagtggaagaagttatccggaagctggtgaagaatcctaaatttgaagaagcaattctgaataaaatcggttcaagaattgatacagaagaaatagaaaaagagattgaaggattggaaaagcagcacaagcagttgaccggagcaaaagcaagacttggacagcagatggacagtctggatatcatggataaattttatgagaagaaatatcaggatatggagacaaggttataccgtctgtatgatgaaattgaaggcgtggagaacagtatagaagaagtcaagaatcgcctgttgaatattcagcaacagaaaatatcagaagaaaacgtctatcaatttcttttatattttgataaactatatgataagttcaccgacctggagaagaaagaatttcttaacagctttgtggaacaggtggacatttacgagcaggagcagccagatggcagatttctgaagcacataaagttccgttttccggtgtattttggagacagggagacacaggaactttgttgggacaacgaaagtaccgttgagacggtctgtttgatgtctaagaaagataaataagtaccaaaaagtggcgtatttccgggccttttgcgaggttaacaccatcacgggagccttgcgaaaagtccggttttcttgtatgagaacttatctaccggacagtctgcatgaccggaattgaaacggtgaaaaatgcggtagggtttagactgcggattagatgtcagaggttgaggcactaggattgttgtcagagccgaccgcagttcagctcactcgatactcgaaggagtagcaggcagtggaatagataacggagataggaggcggtaatgtgagtgattctcagattacaattttttattcttggcaatctgatttgccgggaagtgagactagaaacataattcaggatagtataaaagatgcagttcgtttactgagagatacagtcgatattgaagctgaccgtgatacaaaaggagaatttggttcacctgatattgcgcagactattttctcaaaaatcgacgattgcgatatttttgttgctgacgttagtgctgtatgtcgatatgaggcaactgataaagatggaaacaagaaagtaaaatatatgccgaatcctaatgtaatgcttgaattaggatatgctactcatgttgtaggatgggacaatgtaatatgtgttttaaatgctgattatggcgcaccagaggatatgccttttgacattgcaagtcgaagattgaccccattttcattaaaagatgggaaaagtaagggagagataaaacgatatataaaaggggtaatacaagatattgtcgaaaacatattagaaaatggaaagcgtgttaaaacaggtttttcagatttacgtctgggttgttatgatgacggctctatttctaatatgcttcacccgattgaggtatcaaattcagtctcttttgttaagcacaaaacacaaatattagacgaatctttgaagctggtagaacaaatcagaagtatgaaaattacagaaccatctgaactcctaaatacagaagaggcaagtaatgcagatgagaaacagacaagcaatgcaactgctattattagaaaagatggctcagttctaactcctgtcactagctctttgaaattaaatcttttcaaattacagagggtacatatcaaggatgaggatagaaatacgataatagatttgtgcaaaaattatcttggaatagatatatatgaagatacagattttttcaatattggaaacttagaaagaaaatatgatttaatgtcatcatattcttatgaggggacgaaagacgaggagaacaaatatgatagtatcatgatgcttgaatataatttacatcgtgtgcgaatgctggattggtatgcgacgacttttgacggattgttttttataccacttgcaattgaaaatgcatctaaagtgtacgatgaggatgtagatgtacacgttaagataaataaaggtgttgtagaagtgattattccatcgaaggagctcataaatccagatatgcgaggcttagagggtttgatttatgaagaagatgttataaaggaacttttgatgatgcctgaatcatcagatatttcttatgataccgatatatcatacactttagcagatagtttggctgaaagtcaggcatcagtgagagctcagttcagtggtgctggaattaacggaaatcctcgatataattcagatgattatggcagggagataacaaagtatattgcaatgcctaaagctaaaagcaacgatattgagtttgaattttctattggatctttaagagcaaaagaaaagaaatggttaggaccagccttgttagtaaatccgttaacagacagtttccatatcgaatactctataaaatctaagcattcagatggagatttgtctggaattgtaacatacactaaataaagagaggctccccatcaccggagattatccagtggtgaggagccttcgtgcgtctatggagtcatgcatcaacgtcgatgctgacaccggattttagttctacggtgatgtggttcatttagttctccatcagaaattcatttttatatgctattctttaaaaaaggaggttggcttatgcaaaatattttagtcgtcgaagatgatattgatattcaagaaatattgaataattacttgactgacgctggatataaagtaattattgcttctgatggtgttgctggaattgctaaattcaattcagaaattgacctcgtattattggatattatgctccctaagattgatggttatggtgtgtgtgaggttattcggcaaaagtcaaaagttcccattattatgctgacagctctttcggatgaagaaaaccagttgcgaggatttgaacaacaaattgatgactatattccaaagcccttttcgcccaaaattctgctctgtaaaattgctgctattctacgtcgcggtttacaagataacattgataaggacattatcatttataaggatttacgcatggatattgagggtttccatttgtattgtaaagagcaagaagttatattaacgcagaaagaatttgatttacttcgccttttacttgaaaatcaaggtcgagtatttacacgacaaatgctacttgatcggctatgggattttgatacctatgttgaagaccgtattgttgacagccatatcaaaaatctaaggaaaaaattaaacgtagattatatagaaacgattagaggggtgggatatagaattgataaaagcaattaagaaaaaactgtcgggaaaagtctttctcattacgtttgtgctacttgtatctgcttgcagcgggacttttttctgtatcttaaaaattatgccatcctcatacttagataccttaaaccgaaatgcagaggcacaatctttagagttgctggataccctgtctacttatgataatctggacaagtgcataaaagctatatccgactttgaaattcaaacagggtcaacggtctggcttgatgacgaatatggcaatactctttatccctcgaatgttacgactgaacaagacatggttacagccgatagttatgttacatttgacggtagcaatacaacagatgagaatgtagtatcgacggaaaaagatacaaaagcttaccagttttcattgaaaaacggggcatcctacacgctcgttgtgataacagacctttatgttgtgcggcaatcaacggaagtgttgttgtctacatttccctatgttatcgtcatggtgtttattctgtcaatattgtgtgccttgttctattctcgttttattactcggcctgttctaaaattgagtgccacctcaaagcaaatggcaagtcttgacttttcggggcggtgcgatgaaacgcgatctgacgagttgggatgtctggctcataatttgaattgcttgtccgactcactttcacactccatgttggaactgcaagaagcaaatgcacagcttaaaacagatattgaaaaagaacgagaattagaacgtcagcgaatggacttctttggtgctgcgtcccatgaattaaaaacgccgcttactgttctaaaggggcatttatcgggaatgttgaatggtgtggttggctatgaaaatcactccaaatatctccaacgctctttagctgttacggaaaaaatggaagttcttataagagaacttctctatatttctagaattgaaaaaaataaaacttctatacaatttgcaaatattgattttgcagaattactccgtacagtgattgcagaactaacagattttatttcagagaaaaaactatccctacacataaatataccagatagagtgagttgccctttggatagggcggaaatggaacgagctattcaaaatattctaataaatgctatacgctattcaccagatggcgagcaagtcattgttactgtcactgaaactaatactataataagctgtagtatcgaaaatactggtgttaaaattccagaaactacgatttgccacttgtttgaaccgttttatcgcgtagacatttcaaggaatagcgcaaccggtggcaccggcttaggtctgtatattgtccgaggaatacttgaaaatcataatgcagaatatggtatcaagaacaccgaaaatggtgtgtgtttctggctgagacttccgaaaaagcaataaggtaactccatcaaaaatccacattccctgcaaattaaatccaaatcgctttgatatgatatagtcgtccccaaaaggggcgactatattttttgaaagtgaggtattgcttatgagaacaaaaaaattacttggtatcgggctgggaagtttgttactgcttagccttgtcggtttcggcacagccgcagcagctcaacatcaaaccgaagccgagcctcccatttccttggagaaagaagtcttgtgccgaaccggggaaaatggcttacagttcagccttgatggtaatagctggatgccgcaatctgaatatgaaaaagaaattcccaaaatcgactggtggactgcttctgaatatgaagattggatagccacgcaaaaaaccgaacttgaggctcttattggcacaggagatggttggtatgatgggcagggcgttttccatgaatggacacaagacagcgtaaatgcccaaatcgcagagtacgagaaaatcttggacgagatcaaatctggcacattgtattccaaagataacgacgagggtatcggctatgcacagatccccccggatggcaaagatattgtctctgtctatggggcgaattttgttcggagcgacgggagttctttccacattggtgattttgccactcaggaggaattggacgatgcgattgaaaaggctgtatcagatggtcagataacacaagaagaggctgatactgcatcttaccagtaaatatgtaaaatctgccggacgacggcaaagaaaaagccgtcgtatagcagacaaattgccatgcatctatttcttgcggcggctttgattttcagagccgccgtttcttttcgtctatcccatctaaggcatttaccgagttttgtgagtccatgaatatcacacaaagtatgagcaaagcgggatacccttatgataatgctccgatggaacgttattttaatacattgaaaaatgagtgcaccaacctgtatgaatttgagacagaggaagccctctatcaaacggtagatgatttttcatatgttgaatacaattatgtgcgcccgcatagttataatggttacgctactccacatgaagcaagggtggcgtagctggagcaagatattttttagccacaagtgttacaaaaatgcttgaccacagcagttcgggcgttttattgttggcataagtaaatgatgggaaaagtgaattgtaacttaatgctgatattgatacaataaatttgataattatgctaagcgtaggtattgaaatagaatgaagaataatatgagaatagtggatatagatatggactatttcttaaaggaaatccctattataatatcggaaaacaatacagatagattaccagatgaagattatcaagtatggagcaaagatgaagtgattgattttttggaaaataaactggggctttctaaagaaacaaaaattaaggggaaaatagtcacccaccataatgaggcattatattattggagaaagttaatacaagaagagagattgtcgataccttttgaagtagtacatattgattcacatgctgatttgggtttgggatatccttcttggacatttattattgactctttgattacagtgccagtagaagaaagaacaaaaatagaaaattatggtaacatgtttgaaaagtattatgagccaagaataggagattatttgttatttgcactggcgttcagatggattaaaaaacttgtttatgtgtgtaatcctgcagacataggaaatgattatgtgtggatgattttgaaagatgggatggaaccaaatgataaaattcagttggttcataatgaagagatgaaagcgatagagattgcgtcaaatacagaaaggtattatgcaacagcaaagcgtgaaccagaggtggattttgaaattgtaaggtgtgctgagaatatcagttacaatggagagtttgattatttaaccttctgtgtttctccgaattatacaccaacagctgctgattttattattgaattaatgaaagaatacattgagggggaatagggtatggattatgatagatatattgaattatacagacagggaaaatttcaagaggctgttgagtataaggcaactcaagttccaacaagattagtaaagtattatagcttgaatgataacgtaactgttaataaatcaaaattacaatatctaaaagagcaaagaatatttttaagtacagcttccggatttaatgatccatttgagggaaaattttttaagtttgataaagataaactggaaaagagtggttgggataaagagatggtagtagattactatacttctgtggcgaatggattccgatacacttgcttgagtaatactgatgaaaataatatgccaatgtgggcttattatgcaaacaatcatcagggtttttgtgttgaatatctgctatgtgatatgcagaagaaatatatttttcctgtaacttatgagccagaaagagtatctgcaaatgctattactacaaatttattatatgaatatatgaaaatgaaagaggaaggcagagagtatacagatacatcagcggatgcaaatgtctatttgcagatgttgattttatctcttgcagcaaaacataaaagttgggagcatgaaagagagtatagaattatttgtcatcgagatgattttccggcaattccttccaaaatttacataggtcttaattgtaaagaagaatatagaaaagagcttgttgaagtggctaagagtattgatgtatgcaaagcatatcaaatggaatttgatgaggatagtaaagtgtttggtttgaaaaagagattattaatataatacgctgaaaaggggctatgatattatgtcaaatgaattaaaaattataaatgatgagaattatcagaaatggatttgtgagataaaggaactggttcatgtcagccaattaaaagcggcagttcaagtaaacacagaaatgataagaatgtattggcatattggaaaagaaatttcggataagcatgcagatgcaatttggggaacgggtttctataagacaatgagccagtctttaaaagaggaatttccaagtgtaagtggtttttcggtgacaaacttgaagtacatgaaacgcttttttgaattttacaaaagtgataatgaaaatcgtcaacaggttgttgacgatttggaaaaaatatgttcaataccttggggacaccatattctaataatgacaaaatgcgaaaatgtaacagaagcattattttatgtacacaaaacattagaaaatggttggagcagagcaatgctgcttaattttctggatgtgaatctttataagtcacagggaaaagcaataacaaattttgacagacagcttccggctttgcaaagtgatttggcgaaagaagtaatcaaagacccatataactttgattttctgacattaacagagggataccgagaaaaagaacttgaggatgcattgacaaataatataacaaaatttttgttggaattaggacaagggtttgcgtatatcggtagacagcaaccgattatgattggtcaaaaagaaatggcaatggatcttctgttttaccatatgaaattgaggtgttatgttgtcattgatttaaaagtaggcgagtttgatgcatcttataccagccagatcggaacttatgttgttgcagtaaatcatcaattaaaaacagagatggataatccaacaataggattgattatctgtaaaacaaaggacaatgtggttgctgaatattcactggaagctagtagtgtaccgatagggatttctgaatatcagttgtcaaaagttcttccgaaggaaattgaaagctcacttccttcgatagaggagattgagaagtcgttgaaagctattacaggagagtaaagccggataaacagagatgtatcagtatggaaatattagagaaatcaatgttcctaattaaaacatttagaagtaaaagaaaacgaaaaaagaagtcatgaacatagatttcctagaaataaaatggttggaaggaatgatatgatgagagatgattttaaacaatcaacaataaacttattggcaaatcgagttggatggaaatgtagtaatccgggatgcagaagaacgacacgaggtgcaggaacagaatcgacagatgtgattaatattggggtagcagctcatattacagcggcagctaagggcggtcccagatatgacaataatatgacttcccaagaaagaagatcatacgagaatggaatatggttgtgccagtcatgttcaaaattgattgattcagatgtacaacgatactcggtagataaacttaaaaaatggaaagaaatatcagaacaaatggctgtacttgaattagagacagggacagaaggtggatatacaacagacagagaaattattaagtttcttgtatgttgttttgaccgcccggcatttagagatccaatttgtcaggaaggaagaatggaagattttgataaagcaattgaggatacaataattgccttaaatacaggtattcttagaactagagacggaaatattttaagaaaatcagaggggaaatcagccattagtaatgatgagtggcgtgaaaaacttaatgtaattggagatatgttatctgcattacgaagacgattaaaaatagctaaggcagcaggggcttattctacctatggtgaaggagaggtaatgtattgctttagtgacaggcaactaggagagtggtttgattctactcgtgaagaaatactgaaaattttatcctcgatttgtgaggacatggggatgtcaggattgcgttttccacgaaataagtatagatggtaaattatacggctagattacatcatgaaaataagggataatggataggcttaggatacgagagaggaaataatatgaactttttgattaatagattggataatttggatattggtagcaaaagttttgagtttattcctgaaaatattaagaaggatataaatatggatggaatgattgttggtgcaaatggtcagtttttggttaaccaaaaggatataatggttttgataaaaaaatcaggtttgaaaaatcaaataggtgaaaatatgtataatgctatattaaggaagccaatgatggtttttttaatccctacacaagaaaaagaatttgaaagtaccaaagaagaactcgatatgacatatggtatgaagttaatacatttaaataattttgcgcaggcattttctttgggatgttggtttgtaaaggattcttgcgttatggctaattttatttattggattaatatgcttaatggatataattcacaagatacaagagatatgcccataactatgagtaatgggacgatatcagaaatatgcctaacagatgttgaaatggcagaagcaattgatagaatgtatgaagtatatcgttgtttattgccagatgagtccgcaatggggcgagttgaaaatacatatagcgtaggaacacaggtatggaatatcgataaagcaataagtacggagggaaaaagttttgcaagagctttgataatattacaagaagctcgtagaacaggagtcttatcgagtaaaatagataagtattgttctgttttggaatgtatatatgccataaagaaagaacataagaagaatatatccaatattactgctgcatacatagggaaagatagtgaggaacaagaaagaattagggaaaatatgagagatgcctatggggtacgttcggatggctctcatggagataatttgaaatatttgcaagaaaacaatagggaaaatttggtgaaattatcgacagatatcgatgattatgttagaagagtttttaggaaggttatcgctgtagaaaatttaaattataataatacttcggaagaaaaagcacgtgtaagaaagtattttagcgatttggcgaaaacggtttatcctgaataatttagttcatacatggtgtaagactgtatgcaaaatgttataaagtagataaatgattttgttactttatcaaaatgagtagaatcaagcctccaagtccacaaagatttggaggttttcttctgcccatttttagaggaaagtaatttccgaaataaacaatctatggtacaatatcctagaagttatccacggataagtgaaccatagagaaagagcagaacacaaatcacacgcaggtcagtcagacctgtatctcaaaacaaatctaatctttttctatggcagatgcaaagtggtgcatcatgcttatttttgcaggtccgatagaggaccgttgcatcatttttgaatccaaggcttaacgaaaagccaggggatgtgcatctttattgcacactcatggcatgtggagacggttgccttactttccaagggcgctgagcaaaggtccggtggacctttgctcagcgcggaccgaagtggaacggagaatggtcgacagcaggaaagtgaaggtggacttctctctggaggatatggatctagctgaatttaagggaaaagcaacttatgagcagataaaggcatatgtattggaacagactggacttaaggtttcttcgctgtatattgcacagattaagaagaaatgcggactggatgtcagtgagaacttcaatctggctaaatcagagaatgccagacagccacagtgcacaccggagaaggaagatgcgattatgcaggcatttagacattttggaatcatatagattgtgaataagtagcatcgtgtgttaaaaatatagtaaagtatgggaaaaggacattccggaactgtagattttacaggtcaggggatgtcttttttgctgatatggaagtgttcaagggacaaggtaatgatactgaagtaataagactaatatgaatgatatctatcttatctgattagaagatatggattgatggaactttggttgcttttagtatatattaacagcccggtatttgactttggtactggactgtttgctaattgaatccactacaagatattgaatggaagtaaatgatatgagacaaggtttgttcatgattcttcgtaatgcctagattgagatttttgccaacttatgatattcttatatttgggttttgcacccaaaacacatagaaggtcagggagcggaactatggctaaaaaagaagcaaattttgatttatatatacacgatctgttagttgaagctggcattcaggcagatacacagggcagtaacattgtacctatcaatgaagcactgaaaacagcgtcaaaacaccaaacaggtaaggtaggatttccagaatacatagcggttgtagatgattttgtccttgtcatggaagataaagcggaccgtgcgaatctttgtttaaaagaagcagatggcactatttctatgacggtacaggcaacaaccgattatgctgttaatggtgcgttgcattatgcacagcacattttgcagaaaacaacctacaaaaaggtctttgcgtttggcaatgctggtgatagcaaacatcacactttacagccactttttgtagataagaacggatataaatggctaccggaagtccaaacttttgaaaacttttcaatggcacatattgtggaatattacaaacgacttgtgcttgaagaaacacctccggaagatattgaacttgcagatattttaaaaaaggcaaaggaactgcatgaatatctgcgaaattatggtggacttggggaagatgaaaagccacttgtggtatcagcaattcttcttgccttgcgtgaaaaagaatacggttttaatttaaatcagttgacgggagatacactggagagcaacacggacggtgctattctgtatcaatatcttgaaaaaaatttacaacgtgcaaaagttgccccagaagtaaaaaaacagcgtgttttgaatcagtttacgttgataaaggatagaccacagttaaacacaaagcgtgcggatttaggagataaaacacctctgaaatattttgcagagtatattaacaacaacatttttcaggcgattgtatcaaatgggcgtgaagattatttgggacgtttttatggtgaatttgtttcttactcgggaggtgatggtcaggcacttggtgttgttcttacacctcgtcatatcacggaattgttctgtgaattggtagatttaaaaccgactgatgttatatttgatccgtgttgcggcacgggtggatttttgatttctggaatgcataaaatgctacggttagcaaaaagtgatgcagaacgcaagcacatcaagcaacaacaaatttatggaatagaaattcgtgacgatatgttttcgattgcaacaacgaatatgattttgcgtggggacggtcaaagtaacttgatttgtgaagattttctggcacaagaccctggtgaattgcagttaaaggggggtggcattacagtaggctttatgaatccaccgtattcacaggcaaaaggcaaggacacagcaaacctttcggaattgtgttttatccgtcatttgcttaattcaattacaacaggcgggcgtgtagctgtgattgtacctgtgtccgctatgattggaaaaacaaaagaagataaagccgtcaagcaggatattctgaaaaaacatactttagagggtgttatcagcttaaataaagatacattctatcgggtcggtactgttccatgtatcgctgtttttacagcaggtgaaccgcatccggcagataagattgcaaaattcatcaattttgaagatgatgggtttgaagtcaaaaagcacttgggattagtggaaactgaacgtgcaaaagataaacagcagtatcttcttgattgttggcgtggcaaggtggcggattttccatcaagtttcatggtggaaacaactgttgaagatacggacgaatggttacattccttctactactataacgatgaaataccaacagaagacgattttatgaacagtattgctgactatttgacatttgagtttaacatggtcacacatggtaaagggtatctgtttgaacagaaaggcggtgataataatgcttgagttgcatgatagagaatggaatgaattctacttacgtgatattttcccagatattcagcgtggcaagagattaaaaaatgctgaccatatacagggaaagactccttatgtatcatcttctgcaataaataatggtgttgacgcatttatagggaatgatgacaaagtaagaaagtataaggaatgcctaactttggcaaatagtggcagtgttggaaagactttttatcacagctatgaatttattgcaagtgaccatgtaacatcattgaaatcagatagattaaataaatacagctatttgtttatagcaaccattgtccagcgccttgaggaaaaatatagtttcaaccgtgaaataaatgatgtgcgaataaacaaagaaaaaattgttttacctgttgatgaatctggcacacctgattatgactttatggagcagtatattaaagaacgagaacagcaaattgtacaaaaatacattgaatatactggtaaaaatatccaattcggggggggggacttccgccgttgaaggaaaaggaatggaaagaattttacctacgtgatatttttgttattcgccctggaaagcgattaacaagaagtaatatgcaatctggcacaaaaccctttataggtgcgtccgattctaataatggcgtaacggcttttgtaggcaatacgaatgcgtcagaggatcgaaatgttctaggagtaaattataatggcagtgtggtcgaaaatttttatcacccatatacctgtattttttcagatgatgtaaaacgctttgttttgcgaaaacacaatggaaacaaatatatttacctatttatgaaaactgtaattcttcaacaaaaaaacaagtatgcttacggctataaattcaatgaagaacgtatgcagaaacagatgatactattgccaactgcagctaacggtcagccagattacgattatatggagcaatatgcaaagaagttgtttagttccctaagattacaatatctgcacgaaaaagtgacggttgctatttgaccgtcactttttcgaggtacaatatatcattaagtcctattgtatccatcaaagataccgaggttagtgtgaaagtttgcttgaaacagattttttctttataattgattgttttgtttgttgttgggtatgagagcggcatgacaatggtagaaattgcgaagcggaacaatgtcagtgagaggacgatttataggtataaagcgtattatgacaaaatgaagaaaaaagaagaatagaccattttgctgatgtcagcaatatgttatatgagagttgcggacgatttttttgaccgcaaaatggatggaggagttctatggcagaagataaaaagaaagaagaaattgctgtgattgatattacagaagaatatttgaaagaaagaatttatgaaattcgaggacaaagagtaatcttagatgccgatctttctgaaatatatggttatactacaaaagcatttaatcaacaagtaaaaaataatattgagaaatttgatgaagattttatgtttgaacttacggatgacgaggtagaaaatttgcggtcaaattttttgaccgcaaatcttaacagtaagagcagatataatcctcatgtatttacagagcaaggattatatctgctgatgactgtcttgaaaggaccgttggctgttaagcagagcaagcggacggtaccacaaaatacggttccgtacagctggtaggagaaaccggatatctggtggtcagcaacatgccgttccttgaatactatcagatgctgtttgcgacgatcggcgtactcttagtcattttcgcagtgggaattatcgtggtgatgcgcagcatcgacaagagcgcatatgcgctgtcaaaaccgatcgcagaattggacgagacggcaagcaggctggcagagggagatctggatgtcgagctgaatgttacggcaaagaatgagatcggagaactggcggaatcgattcgggcgacggtcgcgcgcctgaaggaatacattgcctacttaaaagaagcatccggcgcactggatcagattgcagacggaaagctggagattcatctcgaacaggaatatgtcggggaattccgtcagttaaaagacgcgcttcttcatatttcaagttcgatgaatgatgtcatgaaaaatatcagcgcaagttcccagacggtgacttcgagtgccggcgatctggcaaatgcggcacagcagctcgcagagggcagcggcacgcaggcggcagcagtggaggaactggtcgcaacggcgacttccgtggtggagcaggtggaggagagcaaaaaagacgccctgcattctgccgaggagacggagaaagtgacagccatgatggaacagagtcaggataaaatgcaggaaatgatggaggcagtgcagaaaatccacgagacgtcggaacaggttgtcggaatcattgcgacgatcgagcagatcgcggatcagaccaatctgctctcgctgaatgcatctatagaggcggcgcgtgcgggcgaggccggaaaaggatttgcggttgtggcggatgagatcggaaaactggcacaggagagctcaaaagctgccaatatgacgcggaatctgatcagcgtttcgatggaggagattgataagggcaatcagattgcggatcatgtgatggattccctgaagacggcggtagaagccgtggataaagtcaacacgatgatccagaagacggcggaaaacgcggcggatcaggcacagagcatggaacagatccgggtaggaatcgaggagatctcgcagggagtacaggacaattcggcgattgccgaggagagctccgcaacctcggaagaacttgcatcccaggcgacactgctcaatgagctggtgcagcattttgaactgcagccataaaaacatcgaatcccttttgctgacattattttcttaaagtggtaaaataacacaaaagcagcaaaggaagtgtgacagatgaagatcaggcttgtacagacaataagaaattatgacaagaaaaatctcgggaaggatctgaccgccgggctcatcatcatggcggtctcgattccgatctccatgggatacgcgcagattgcgggactgccggcggtatacggactgtacggatcggtgttcccgattctcctgtttgtgttgttttcgacgtcaccgcagttcattttcggcgtggacgccgcgcctgccgcgctgatcggagcggcgcttttggatctgcacatcgagagcggctcagaggaggcgctggcggcagtgccggtgctgaccgcgtttgtggcgctgtggcttctcgcgttttacgtgatgcgggcgggaaagctggtcaactatatctcggcgccggtgatgggaggctttatcaccggtatctgtacgaccatcatcctgatgcaggtgccgaagcttctgggcggcactgcggggacgggagaattctttgagcttgcggagcatatcgcggagacggcgggggagatcaacctgccgtccctggcgcttggcgcggctgcgcttgtgatactgctgattgcaaaaaagctcatgccgaaattcccgatggcggtccttttgatggcagcgggcgctctgatgacaaagtacctgcctctgcgcgcttggggcattaagacgctggatgctgtggagccgggacttccggtctggagcctgccggattttacggcggtgccggtaagggaggcggttacgatcagcctgtcggtggcggttgtcatcatggcggagacgctgctcgcagaaaataattttgcacagaaaaacgggtaccgcatcaacgacaatcaggagatcctggcatttgcgatgggcaatcttgccgcggcgctgaccggatgctgcccgatcaacggctcggtctcccggacggcgatgggagagcagtatcaggcaaagacacagctgaccgggattgtggcgggactttcgatgatcgtgctgctgcttggcggaaccgggtttatcggctatcttccggtgccggtgctgacggcaatcgtgatctccgctctgcttggcgcgacggagtttgagctggcggtccggttgtggaaagtcagccgcacggaatgtctgatctttgccggtgcattcttcggagtgctgatgctcgggacgatcaacggcgtactgatcggcatcatcctctccttttccgagatgattatccgcactgcaaagccggcgcgctgttttctgggaattcagccggggcaccggcatttccgcgatctgaaagaaggaagccagatccatgcggttgagggagtgttaatctaccggttcagcagcaacctgttttttgccaacatacaggtgctaaagcaggacatcgaggaccatgtgacggagcagacaagggcggtcatcctggatgcgagcggcattggcagtatggacatcacggcggcggacggactgggaatgttatatcagtcgctgaaagaaaaaggcatccgcttttacatgacagagcacatcgccgatttaaacgaacagctccggaaactggggcttggctacatgatcgaagaaggaagcgtgcgcagaacgatccatattgcgttaaaagatatgggaatcaagcgcccgtatccgctggagggcggtgtggacaatgacgaccgcagtgcctcgagaaagcgcgcggacaaccgcgtgcaggaatttgtctgggcatttggcacggagacggaggaacagattgaaaaacagattcttttgcagattgaacagctgaaggagggcggtgatgtggaaaatctgctgcatggcagatggtcacacatggaagcaatggatgaagacgagtggctggaacatctggaagaacacttaaaggagattgtgaacatctccggaaaggatgagaagacactcgcaagacgtctggaggaacaccgcagggaggtgcatgaccgcattgcaacagagcatccggagcttgcggagcgcttcaaggagcgcagacatgtactggatgagcatttaaagcagagaagaccggaggtctatgagcttgtggtgagtctgcgcgaaaaggaaaagacagatttaaaataaagaaacaacaccgttatttaacagggtgccggagagcgcaatcagcctctcaagcggcactctttttttgtctgccacccactgccggtaaatattgacggaggtgacgcataaaaacgtgttgatgatattctgctcctccctggaaaatgcggcgtagggattatgtctcgtgcgattgtgaatcatggtgtttaagaataatttatcggcgaattcgcggtagcccggtgcgcataaaaggcgctcggcgtacggctcctgtctggcggtaaactcgaaaaagacgcggtttacttccgtaaaaggcgcatcgatcgggagctggtcgatggcatggtaatactcttcggtgatctgcccaaggagatcttcaaacagagcctcgatgcaggtatagtgcagatagaacgttttccggtggatcagaaatacaacgagtgccatgctcagaaaatggatgaagaatactggcaagtgccgcggcagttgtgctatactgggagacagaacgacacaacagaagaaagggagtatgatattatgatgaatccggcttcacttatgaagattatgaatgcgagaaacaagttcgttgagaaccatccgaagtttgcggcgtttttaaacgcggtattttctgcgggcattacggagggaacagtaattgaaatcaccgtcaccaagccgggcgaggagccgatcacgaccaatatgaaggtgctccagtccgatctggatttattggacgagttaaagaatctggcgcagtaacccggcgcgcgcgcactgcatatgatatagcgaagttatctatagggagtatagagtggactataatcaggagcagtttttccgcgcgcagtttgatgtgcccaagatgcctttttatatgagctaccccatgcagaatctgtatctgaccgagatggagtatgagaaggatatggaccgcatgaaggagctgtatcccaaagaggttggcaggattgtggagtgcgtggaagacgaatgtgacagaatggaatacgagggcagcctgatgtttgatgagtatccggaccgtctgatgattgagatggtggtagaccgcatccagaagaaagtcacaggagaagacggcgaactggaggcagagcagtttcacggaggcatgcagccgccgcccggacacagaccgccgccaccgccgccgcccggacagaatgatcatctgcgggagctgatcggtgtgattttaaacaacgaaatgtaccggagacgctgccgtcaccgccgctgcagacgctggtggtaacgggggtgcgaagccccggataagatcgaaaacaattcttaaaaatcagagaaagtcattgcggatttattttaaaatgcatacaatataactatcgcgtttttgtgcgatagttattttgtgttaatataactatcgcgtttttgtgcgcggtagttattttgcgttatataggaggaatgaccgttgcggaagggaaccataaaggcagcagtcttggcggcagtgttcatcggagcagtgcttatatttggaagatttatgaatgatactaacgaggatctgacgacggagatgaaggaggcgacgctgccggtcatcaccatgtatcagggcgatcaggagctgaatgaactacacgggtatgtgacggagatggatgccgcatatatgcgcgataccattacgccggtgggggaagaccggaagcttccgattgtgatacagacgaatcagacggcggtcgacacgatttcctatgagatccgcagtctcgatgccacacgcctgattgcgaatgcggatgtcacctcctatgaggagcgcagcgggaagatcacggcagatctgcagatccagaatctgctggaagagggcgaagagtatctgatgattatccgcctcgggagcggagaccgttcgatctgttactataccaggatcgcggagccagtcgactgctatgtgagcgagtgcgtcgcattcgtcaaggattttaacgataagacgttcaacgatgagacctccggaacactggcgacttacatggagcggacgaccggggataacacgacgctgcagttcgtgtcgttaaattcttctctaaagcaggtgagctgggcggattttaagggagagcgtctgacagagccggttccgtcaatcaaggagatcacaccgacctacaacgtgatcgtgctcgattatgtggtatccagtgtcaacgagagcggtcagattgaatactataatatagaagaatattacagggtgcgctacaccacaagccgcatctatttgctgaatttcgagcgaaccatgaaccagattttccgcggagaaaatgacagcgtttacgatcagtatatccagcttggaatccgcgaagcgaacgttgaatacaaggcgaatgaggcgggaaccagtgtggcgttcgtgcaggagggagaactctggagctacaatacggtggaaaatacgcttgcaaaagtgttcagtttccgcggttacgagggaattgacagccgcgagaactacggagaacacgacatcaagatcgtcggtgtggacgaagccggaagcgtggattatatcgtgtacggttacatgaaccgcggaattcatgagggggaagtcggaattgcggtctatcattacgacagcctggcgaataccgatgaagagctggttttcatcccgtcagataagtcgtatgaggtgatgaagtcggagctcgggcagctcatgtacgtaaacgagggcggagagcttttcctgatgctggacgggtgtgtctacggaatcgatttaaatactctctcagtgcgggaactggtgacggatctgaatgtacaggattttgcagtgtccgcgtccaaccactattttgcgtggatggagacggagggggattcccagatgggcagcagtgtgatccatgtgatgaatctgtcggatcagagcacgcaggagattgcggcgggcaccggggaagccatcaagccacttggattcatggacgaggactttgtgtacggcattgccagacagtcggatattttcgaggacgccgccggaaatgtgacatttccgatgtaccagatccggattgtggatgtctcgacaaaagatcttaccgtgcagaaaacatacgaaaagagcggctattttgtgagcggtgtgtcgatcgaggactacacgatgcacttgaaccgcatccagtataacggcacggcatatgtcccggcggatcaggatatgatcatgaaccgcgagggagattccggaaaacttgtcaatattgcaacaagcagttcggcggaaaaagagaccgaggtgcagcttacgattgccggagcgtccgcggaaaagacgccgaagcttctcacgccgaaggagacgattttagaggaagagcgcacggtggcaatcaaggaagagggcagcacaaagcactattatgtatacgtgaaaggtgatgtggtgctggcgacagacgatgtcacagaggccgtcacggcggcaaacgacagcatgggagtcgtgattggagataacctccagtatgtatggaaacgctccagaaagtccgcacagccggcactgtcggatatcgcggtcggtgcggaggacgccggcgcaggaagcattgcgcagtgcatcaatgccatgctggaaaaagaaggaatcaatatcagcgtgaacgcactcattgagggcggagagacgccgaagagtatcctgaacaatacgatgaaggatatgcaggtgctggatctgaccggatgcaatattgaggaggttctctattatgtcagctgcggcagccctgtattttccatgacaggaagcacggatgcggtgctgatcatcggatatgacagcaacagcgtcgtgatattcgacccagcgctggggacgacataccggaagactctgaccgaggcggatgagatgtttacagcggcaggaaatgtatttttcacatatctggtgaaatgaaagtgcataaaaaagctcttaaagtaggaaattattcgtgtaagtttaacagatttcatgttcttctattgcaaattggaaatagatgggttatattttgagacgtagtacttgaaaagaggaaatggagagattatgagcagaaaagagattgttgtatcgaatgtctcagaggaacatagtaatccgattgcagaactggttcaggttgcctgcagatttgacagtgatattacacttgagagtaacaaccgccggataaatgcgaagagtattatgggaatcatggcatttaacccgtccaaaggaatgacggtgaacatcgttgccgagggcagtgatgaagaggaagcattagtagcaatggaaaagtttttagtatgtgagtagtttttttgatgaggaggagggctctcataatggaaaaaaagacgacagcgaaacttgatgagactaaggcagcagtaaaggcagcagaagcaaaagttgcggcgaaggttgaggagaccaagacagcagcgaaggaagcaactgcaaaggttgtggcaaaagtcgaggagacgaagaacgcagccaaagagacagaggtaaaggcggctacaaaggtagaagaaccgaagaagacagcagctgagaccgcaaagaaaagaaaaccaagaacaaagacagcgaagaaggcagcaaaggaagagcttaagcctgaagtgtatatccagtatcagggacgtgaaggcgtggtagaggatgccattaagaaagtgacagagcagtttgtggcagaaggtcacagagcatccacgatcaaatcacttcagctctacttaaagccggaagagaacgcagcgtattatgtgatcaatcagaaaattgctggcagagtagacttgttttaatacataggcataataaagggactgacgcttttagcgggcagtccctttttggattttgtttagttctgctctgctttgtactttgcaaccagacgctggatgcggtcatacggatttaagagatcgctgatcgagctgtcgtgatttaacgtatcaatgatataagcaatgtatttgctcatgtcgcagttgatataatatggctttgcgagcagttccggtgtctgataggtcaggttggtggttacgaccttgtagattgtgccgcctgcaacagcctcgtcaaagcgctccaggccgttggtgaacagaccgaaggttgcaacaacgaagatacggtttgcctttctcttctttaactcggtagcaacatcaatcatactctcgccggaggagatcatatcgtcgatgataatcacatccttgccctcgacggaggaacctaagaactcatgtgcaacgatcgggttgcggccgtctacgatcttgctgtagtcgcggcgcttgtagaacatacccatatccagaccgagcacgttagccagatatacggcacggttggtaccaccctcatccgggctgataatcatcatatgctctgcatcgatctttaagtctttgacttctcttaagatacccttgatgaactgataagcaggctgtacggtctcaaatcccttgagcggaatggcgttctgtacacgcgggtcatgtgcgtcaaaggtgatgatgttgtcgacacccatagcggtgagctcctgcagggcaagcgcgcagtctaaggattcacgggcggtgcgcttgtgctgacggctctcatataagaacgggatgatcgcggtaatacgtcttgcttttccgccgacagcagcaatgatacgcttcaaatctgcatagtggtcatccggagacatgtggttcttgtaaccgcatacagagtaggtgaggctgtaattggtaacgtcgaccatcagatacaggtcatagccgcggacagactctttgatgacaccctttgcttcgccggttccgaaacgcggcactgcggttgagatgatataagaatctctgcgatagcccttgaacgcagggtcgttctggtgctggtgctgtctcttttcgcgccagccgacaaggtactggtctaccttaagaccgagttctttgcagctttccagtgggatgagacccaatgctccgtcaggcatggtttctaagtttctttcatcgtttggcatgaatggttcctccattaaagaatagttacataggttttattttcaatagattgctctaatgaaatacatggataaaaatgttaacggttgcgctttaagatacggatgtccgcgccgaagagctttaataatgtgtaattgctggatattctggataaaacgcgctctgaataaatatcggcaagctggttcatcccgaggtttgtggagatgatcgtggatttctgccgcagaatgcgttcgttgatacataaaaataactgcgaggtcgtaaaggaattggacagctccgtgccgagatcatcgatgatcagcagatcgcagtcgaaaatattccggtgggaaagcagtgcctcctcgtcccgtttgaacacgcccttgcttaatatatcaaataattggaatgcggtaaagtaaatgacggaatgaccgcggtctaacagctccttggcaatacagttggacaaaaaggtcttgccgatgccggtatctccgtagaggtaaagattggagaacgtgctgtcgaaatgatcgataaaatcgtggcattttgcgacggcatcctttgctgtctcaagggacgagcgtccggttgccggattgatgtcatccgcagaatagtaatcaaaggaaaacgtggaaaaattctcacgttccagaatctcttttaagttggactgggtatagaccagattgatggctgcctgttcaaaacagtgacagcgtctgccgttcacataaccggtatccctgcagtccggacagtggtacaccggcttcagataatcagaagtaagcccgtgctcctgcaacaactgctccttctgcctgcggtagtccgagagcttttcacggagcgtggccagagcggcctcatctccgtctaacagccggcgtgcctgctcgacagaacaggtagcgatcgcgtcatcgatctctttaagtgccggaatccgggcgtagacgtcctttgtgcggcgctcgagctggtgctggctggctaactgtttttcgtcatatttgcggaatatctcgtcatactgtgaattgcttagcggcatctgtttcccctttaaatcagtgtacgttcgtggtcaaaagcatctgctccagttcgtcgtagtcgtaggagcgctgcgtgaaattgttgaacttgtttttggatgctgtattggcggcagcggaagcggaactttttttgcgttcctggtgcaccgcatccagttttgcaatgtcggacagatggtgaacctgctttttgttccagtcggaaagaatggaatccgtgtatttgaagttcggctgatgcagacttgccatggtgcgcttgcatgcctcaaggatgatgtcagagtcgaaaccgtactcgttcgtccagcggctgatataagcgatctcggtggaaaccagcttgcgtccggtaatgccgaacgcgttcatcacggcgtagtacattttgccaagaaccggggaaccctgcttggcctcctcgacggtcgtgatatgctgatctgcccagccaagtgcgactttttctatgtatcggatgctggtgtgattgttgctcacacagctctcaatcaggtatacgatcagctcggtggaaaatccgagcacatcataaaaatagagaagcgtattgatgtcggtggcgcttaaggtgcggccgagataacgctctgcgatgaagaacagctctgcgacggattcattctggcggaaattcaaaatatcgtccgcggaatagctctttttggcaggaactgtctgcgccggtgccggtgtttctgccaaagcggcggaagcaggggcgttctgtaccggtgcgccggctggctctgtctgtcttccggaagtccccggatcagacggggcggcatctctggacgaagaatccagcatgcggataccggtcagattcttatcattgtcatattcaagctgcagcaggtgcatgcgctcccaataggcaagggcacgcttgacatccttctccgtgtgctcgaacttgtccgcgatggaagaaatggaaaaagacgcctgcggcgcattcataaggcgcagcaagtagaggtaaatcttgacgaattccccgttggcatcagacatatattcatcgataaacgtgttggaaacactggttgcagagactggactgtcactgtgtagcttaatatttgccattgaaaccgactcctctttctcaaacgtaacaagcgaaatgtacggcagccgccgacattccctgatgcattatagcacaggaaaactggaatgagaagtatcttttccggaacacatccggcacagacaatcgaccgcagaaatgtggataatgtggataaagaaaacgaatccggtggaaaccggattatggaaacgaaaggtttggcgcaaaagacggcaaagacggcaaaagtgcaggaaacgtgtataaggattatgtaaacaaaaaaatccacattcaaaagttgaagttttccccaattgaatgtggataaagtggataacttatttgccgagaagatgttcgccaacatttacaatgtctccggcgcccatagttatcaacaagtctccgtttacacaattttttaataaaaatttttcgatctcctcaaatgacggaaaataatagcattccgtgccgcgttccctgagcttggagaggatatcgcgggaggagacgccgtaggtatttttctctctggcggcgtagatgtcggcaaggacaaccacatcagcgagggagagcacatcggcaaaatcctctaaaaatgccttggtgcgcgagtaggtgtgcggctggaagcagagaaccagccgtttgtgcggatagttcttggcagcggttaacgtcgcgcggatctccgtcgggtgatgcgcatagtcgtcgatgatggtgacgccgtccacgcagcctttgtactggaaacgccggtcggcaccaccgaagtcggataatccttttgcgaccgcgtcagcggcaagaccaagatcatctgccagcgcaatggcagccagtgcgttggatacgttgtgcatgcccggaacgtgaagcgtgactttcatcagagtttcctgtcctttcatggcggtgaagcttgcacaggctttttcatcgaatgtgatgtctgccggatggaatgtgcagctgtcactgagaccgaaggtaattacctgcggctttaatccggcggtaatctcggtataatccggaatatcgccgtttatgatgatcgcgccgtcctcccgggtgttggatgcaaattggtggaatgaatggcggatgtcctgaatatctttaaagaagtcgagatgttctgcttcgatattcagaatgatgctgtatttcggataaaaatgcaggaagctgttcgtgtattcacacgcttccgacaggaagaaatcggacttgcctacccgcaggttgccgtcgagcgcttttaaaataccgccgaccgtgatggtcgggtcgcacttggctgcaagaaggatctggctgatcatggatgtcgtggtcgtcttgccgtgggtgcctgccaccgcgatggagttgcggtaattgtccatgatctgtccgagcagctctgcgcgcggcatcatcggaattcctttttcgcgcgcacaggcgaattccggattgtcctcgtggatggcagcggtgtagacgacaagatcaatatcatccgtgatgtttgcggctgtctgaccgtagtaaactttgatgccgagatgctctaagtgtctggtcagatcagattcctttgcgtcggatccggataccgtaaaatgctcttcggagagaatctcggcaagcccgctcatgctgatgccgccgatcccgataaaatggatatgtatgggttctttgaaattgattttatacattataattctacctgcctgtttttctttctatgataaagttcattataaccttatcttactgatttgcaaattcttttgggataaaatattttcgacagaaagtgaaagaggagtgtagaaagagaaaagatttgacgaaaatgtcaaaaaatagaaaaatgtactggcaaatttgtgaaaaatgatgtacatgggtggacgattatgttataattataagtgcaaagaggaatagactgactagaaagacgagaggtgattgacgtgattcgaaaagaaatgatagccatgctattagctggaggccagggcagccgcctgggagtgcttacagcgaaggttgccaaacctgcagttgcgttcggaggaaagtaccgcattatcgatttccctctgagtaactgcatcaattccggaattgatacggtcggagttctgacccagtatcagccattacgtctgaatacccatatcggaatcggtattccgtgggatctggaccgtaacagcgggggagtgacggtgttaccgccttatgagaagagcgataacagcgagtggtattccggaacggcaaacgcaatatttcagaatatgaattatatggagcagtatcatccggaatatgtgctgatcttatccggcgaccatatttataagatggattatgaggttatgcttgatttccataaggagaatcatgcggatgtgacgattgccacgatgccggtgccgattgaggaggcaagccgttttggtatcgtgatcgcagatgagaacaagaagatcatggattttgaagagaagccggaaaagccgcgcagcaatctggcgtccatgggtatctatattttcagctgggataccttaaaagaagcgctctatgccatgaaggatcagagcggatgtgattttggtaagcatatcatcccgtattgccacgagaatggaaaacgtctctttgcatatgaatacaacggctactggaaggatgtcggtacactcggctcttactgggaagcaaatatggagctcatcgacctgattccggagttcaatctgtacgaggaatactggaagatctacacgaagagtgatattatcgagccacagtatctctccgcggattccgttgtggagaagagcatcatcggtgaaggaaccgaggtatacggcgaggtacatagttccgtgatcggaccgggcgtcacgatcggcaggggggcagtgatccgggattccattgtgatgaaaggaacaacgattggcgagaatgctatcatcgataaatcaattatagcagagaactgccaggtgggagcgaacaccgagcttggcattggagaagaggcaccgaataagctcaatgcgagcatctattcctttggtctggtgacggtcggagaagacagtgtgataccggacggtgttaagataggaaagaacacggcaatttccggtacgacggacaaggaagattacccgaacggaattcttgagagcggtgaagtaatcattaaggcaggtgactcggtatgaaggcaataggaattattttagctggtggtaataacagccgtatgcaggaattatccaacaagagggcgattgcggcaatgccgatcggcggaagctatcgaagcattgatttcgcactcagcaacatgagcaactcccatgtgcagactgttgcggttctgacacagtacagtgcgagatcgttaaacgagcatctgagctcctccaagtggtgggatttcgggcgcaaacagggcggattgtttgtattcaatcctacagtaaccgtggataacagctggtggtaccgcggaacagcggatgccatgtatcagaacatcaatttcttgaagaagcgccacgagccatatgtcattatcacgagcggtgactgcatttacaagctggattataataaggtacttgattaccacattgagaagaaggcagacattacggtggtatgcaaggatatggcgccgggagaggatgtcagcagatacggcgtggtccggatgaatgaagattccaagattgtagagttcgaggaaaaaccgatggtatccaagtcgaacacggtatcgaccggaatctatatcgtgcgcagaagacagctcattgagatgctagagcgcagcgcagcggaagaacgctgggattttgtgacggatattctgatccgctataagaatatgaaacagatctatggttataagatgaaggaatactggagcaatattgcgaccgtagaatcctactatcagacgaacatggatttcttaaaaccggaggtgcggaaatactttttccatgatgagccgaagatttactccaaagtggatgatctcccgcctgcaaaatacaatatcggttccgatgtgcgcaacagcttaatcgccagcggatgcatcgtcaacagcaaggtggagaattcgatcctgttcaagaaggtatttgtcgggaagaattgtgtgattaagaattccatcattctgaatgatgtttatatcggcgacaatacacatattgagaactgcattgtcgagagccgtgatacactcaaggcgaacacctattactgcggcgacaacggtatcaagattgtatccgagaacaacgaaaggtatgtactgtagagaagggactaaagggggacagaatctatgcagattacggacgtgagaatcagaaaagtcgagaaggaaggcaagatgaaagcggtggtgtccatcaccatcgatgaagagttcgtggtacacgacatcaaggtgatcgagggagacaagggattgttcatcgcaatgccgagcagaaaggccgcggacggggaataccgcgacatcgctcatccgatcaattcggacacaagagagcggatacagactctgatccttcagaaataccaggagacaatggctgctgaggaataataccgggaagaagccggatggcagcttacccaggaaaataaatgcgcacaggttttacgggaaggtaaagcctgtgcgcatttgtttatacgtgcagggatcgggcagcggtgcagaaaactcttgtaaaatctgcaaactaaggtaaaatgaaacgtgaactgtgacaagatcaaacaaaagacagcaggaatcgtcaattacaatagatggcaggaggagtatgatgagtcagttaaaagcagtgatacttgcagcgggaaaagggacacgaatgaagtcggatctgccgaaggtggttcataccatagagggaaaatgtctggtagattatgcgattgaggcggcagagggagccggcgccggtgagatctgccttgtggtcggctacaaatacgagatcgtgcgggagagcatttcgcacaaggacgtaaagtttgtattacaggagcagcagctgggaaccggtcatgcggtgcggtgtgcaaaggaatttctcggggaggaaggacagacactgattctgtttggagatacccctcttatcacggcagagaccttaaagaaattaagggagcatcacattgcgagtggaaatacagtgacagtgctctcagcgatggtcgaggatccgaccggatacggcagaattatccgcgatgcagacggcaattttgtgaagagcgtggagcacaaggatgcgacggaggcggaactggcatcccacgagatcaactcaggtatgtatatttttgatacgaaggagctgcgtgaggcgctggatctgattttgccgaataatgcgcagggtgaatactatctgccggatacgctcacaattattaaggaaaagggactgaaggtggatgcgtatgcgctggatgacccggaggatatcacaggggtcaacgatcaggagcagcttgcggctgcagcagtcgtgatccggcggagaattgcaggcaacaaagcaaagaataggagatagcgatgttcttgatcgtaggtctggggaatccgggcaggcagtatgagcatacacgccataatgcgggatttgatgtcatggatgcccttgcggaaaaatataatatcagtatcagcgaaagtggacacaaggcgcttttcggcaaagggatgatcggcggacagaaggtgattctggcaaaaccgcagacatttatgaacttaagcggcgagagcgtggcggaacttttacattattataagatcgatcccgaggaggagcttcttgtcatttttgacgacatcagcctggcgccggggaacatccgtatccgcaaaaaagggagcgccggcgggcataatggaatcaagaacattattgcaatgaccgggacggagaactttaagcggattaaggtgggcgtcggcgaaaaaccggcgggatgggatctggcggatcatgtgctcggacgcatgagtgaggaagaccgcgcggcatttgaggaagcggtgaaggaatccgtaaaggctgcggagatgatcctggaggatgagattgatcaggcaatgaatgattttaacaggaaaaagcgggagagtcagtcatgaagacattcacacagcccatgcaggggctgaaagaatttgaagacctggaagcggcactgccgaagctatccggcgtcattcagatttccggctgtatcgatgcagctaaaccacatatgatgtacagcattggcaatggttctggaaacagaatcattgttacgtttcaggaacaaaaagcgaaggaactggcggaggaataccgcttttttgatccgaacgctgcctattatccggcaaaggatattctgttttaccagtcggatatccggggaaatgtgctgacagcggagcgtatcaatgccctcaagatgatggcggaaaagcgctcgtgcacaattgtaacgacgtttgacggactgatgaatccgatgccgtcgccggatcagtttatcagtgcggtgcggaaagtggcggtcggggacgtgatcgatctggagcagtttacaaggcacctggcggaactgggctacgagaagaattatcaggtgcagacaagcggtgaattctccgtgcgcggcggaatcattgacattttcccgctgacggaggagaatccgttccggattgaactgtgggatgatgaggtcgattcaatccgctcattcgatgcggaaagccagcggtcgatcgagaatctggatgaggtccacatctatccggcgtgcgaactggtgctgaccaaagaggagcgcgacgccggtattgcgcgcattctggcagaagcaaagcaggtttcggaaaagctccgcggggagatgaagaccgaggaggcgtaccgcgtcaagtctgcggcggaccaggtggcggaggaagccggggagctgggcctctctgccgggctggacgcctacctgtcctatttttgcgaggaacgcgtctctttgctcgattattttggaaaacaggatacgctggtgttcctggatgagacgccgcggagcattgagcgcggaatggcgacggagaccgaattttcggagagcatgaagcagcgcctggaaaaaggctatattctgccggggcagatgcgggaactttttacctgcaaggagattctgggaaaacttgcggggcgcagatgcatctcgctggtggcactcgaccttaagaatccgcatctggagattggaacacggctgaatatccagtctaagacggtcaatccgtacaacaacagctttgaacttctgataaaggatctggagcgttacaaaaagaacggctatcaggtgatcctgctgtcgggatcgagaacgcgcgcgaagcgtctggcggatgatctgatggcggaggggctgaacgctttttattcggaagactacgatcacgaggtaaagcccggcgagatcatgacgggttacggcaagataaaaaaaggatatgagtatccgatgctgaagtttgttgtgatctccgagagcgatattttcggcggcgagaagaagaaaaagaagcgcaagcgcatctatgagggagagaagattgcaagctttacggatctgaacatcggtgactacgtggtgcatgagagccatggactgggcatctaccgcggtattgagaagatcgaggtggataagaccgagaaggattacatcaagatcgagtatgcaggcgggggcaatctctacattctggcgacgcagctggagcagatccagaaatatgcaggcgcgggggcgaaaaagccgaagttaaacaagcttggcggacaggagtggaacaagaccaagtcgagggtcaagggagcggtcagggagatcgccgaagacctcgtgaagctttacgcagtgcgccagaatgaccggggatttgcgttcggaccggacaccgtgtggcagaaggagttcgaggagatgttcccgtttgaggagacggaagaccaggatcttgccatcgcagcgaccaaggccgacatggagagcacgaagattatggatcgtctgatctgcggcgacgtcggatacggaaagacggaaattgcgatccgtgcggcgtttaaggcggtgcaggatggcaagcaggtggcatttctggtgccgacgacgatcctcgcccagcagcattacaacaactttgtgcagcgcatgaaagattttccagtcaacattgatctgctctgccggttcagaagtagcgcggaacagaaaaagacgatcgaaaagctgaaaaaggggcaggtggacatcatcatcggcacgcaccggctgctgtccaaagatgtggtctacaaggatctgggacttttaatcatcgacgaggagcagcgcttcggcgtggcgcacaaggagaaaatcaagcagcttaagaccaacatcgatgttctcacactgaccgcgacgccgattccgcggacgctgcacatgagtctcattggcatccgggatatgagcgtgctggaagagccgccgatggaccgtgtgcccatccagacatatgtgatggagtacaatgaggaactggtgcgggaggcaatctccagggaactggcgcgcggcgggcaggcgtattttgtatacaacagagtgcgcgagatcgccgatgttgcgacgaagattgcggagcttgtgccggaggcgaacgtggcatatgcgcacggacagatgaaggagaccgaactggaaaatatcatgtatcggtttatcaacggcgagatcgatgtgcttgtatccacgacgatcattgagacgggactggatatttcaaacgtgaatacgatgattatccacgatgcggacaatatgggtctttcccagctgtatcagctccgcgggcgtgtgggcagatcgaaccgcacggcgtatgcgtttttgatgtataagcgggataagatgttaaaggaggtcgcggagaagcggcttgccgcaatcaaagagtacacggagcttggaagtggctttaagattgccatgcgtgatctcgaaatccgcggagcgggcagcctgctcggtgagcggcagcacggtcacatggaagcggttggttatgatctgtactgcaagatgctaaacgaggcggtcaaggaagcgaagggcatcgcggtggaggaaagctttgacacgtcgatcgatattgtgatcgacgcctatatcccgatggggtatattccaaatgaactgcagaagctggacatctacaaacgcatcgcagacattgagacgcaggaggagacggaggagatgacggaggaactgatcgaccgtttcggagatccgccgaagtccgtggaaaatctgctttacattgcaaaaatcaaatcgatggcgcaccggctttattttacggaagtggcgcagaagggtgagagtgtccgttttactctctatgagaaagcacggattgatgtgacgaagattccggaactggtggcggcatacggtcagaaggtgacgtttaccgctgatccgaagaatccgtacttcacatatcacctgaaaaagaattcgagggacaagaatgtggacatcaaatcggtggtggagcagttcctagccgacgcaggaggatttctggcggagcgggaagcaccaaaggaagggtaaaaaggtgtagaaagccaattttcgggcaccggtggaccggctctccggcgtcggaaaagcttgaaaaaagtatgaaaaatattgcgacccggagaaaattgcactataatagagcaagactgccatggcaagctgtcatggcatataccaggaggaacctatgagagcaaagagatggagcgcactgcttcttagcggtgttatggcagcatccatgttaacaggatgtggaatgaataaaaatgagacagtggcaacttttgatgagacggaagtgccgcttggagtagcaaattttgcagcgagatttctgcaggcaacatatgatgatttttatgtggcatattttggcgaggacgtatggtcatccgatctgtacaacaacggcaccacgatgcaggacaatatcaaggacagcgtgatgcagtcactgttcgatatgtatacactggaagcgcacatggcagagtacgatgtggagctgacggaggatgacaaggcggagatcgcagacacagcggctgcgtttattgcagacaacagcaaggatgcattggatgcacttggtgcagatgaagagactgtggagcgttatctgacactggcgacgatccagaaccggatgcacacggcgatcattgcggatgccgataccaatgtgacggatgaggaagccaacacaagctcctacagctatgtcaaggtgtccaagcagtcccatacggatgaggatggcaataccgtggagtacaccgacaccgagctcacactgctcggcaagacggtcggtatgtttgacatggacgccaaggcgggcacgctggaggatgcggcagagcagtatgactatacggtgagcagcggaacgtttaccgcggatgacagcacactcgatgaggcggttcttacggcactgcagggactggacgaaggggaggtgtcggatgtcatcgacacagataccgattactatgtagttcgtctggatgagaagacggatgcggatgcaaccgagacgaccagacagaacattatcagccagcgccagagcgatctgtacgacgagacgctcaaaggctgggaagatgagcatgactggatcgtgaaggattccgtgtgggcgaaggtaacatttgacaacctgttcaccacaacggtggaggatacggagactgagaccgtcacggagagtgcgacggaatagaagaaaagctgcggcaatgacagatattgcggcaggagacagcgaagattggctgtaccggtgatcctcgttaaagagcgtaactccggtgttccagcgaaaacaggcgggaggattctttgaaacaaaatgcgagaatttcttctctgccgtttttgccagttccttccgtgtcttggccacgttttgacactccgcgaggatgtgtccgacaagccgcagacaatgagcggactttctggtgcccctagcggcaccgcttcacagacaatataaaaccgcgcgaaccgaaactcgttggcatctgctattgaaaataaggcagatgccaattcaaacatcggcttcgcgcggttatgttttgtttagcggtgccaacaaggggcacacacaaaagtcctaaaattgtctgcggcttgcggacacgcctccggagtgttcaaaacttggaaagacacggatcatcacagctggcaaaaacggcggagttagaaattccgtattttgtgatcagaatcctcccgcctgtttttcgctggaacgctcgcgttatgccctttaacgagcaacagcgatccgacgatctgctgtctcctgctgcatgtctgtcattaccgcagcttttcgttctttacgagcatctcttcgatgatgccctggcagtgggcaccgattttcttcttcgtctctttatccagctcgttcggatagatcggcttgccgtactctaagatgacgtgcgttgcttttaccttcggaaaatgattctctaaaatatcggcggaaccggtgattgccatagggacgatcgcacacccagttttctctgccatcttgaaacttccctccttaaaaggaagcatcaggtcgtcggtcttgttgcgcgttccctccggaaaaatgcacatcgagatgccgttcttgatgtgatcgatgccggcaagaatggtctttaaggcttccttgacgtcatcacggttgatgaacaggcagtagagacgcttcatccacagggaaagaagcggaacttttgccatgtcattcttggcgacgtagccggtcagacccgggcatctggcataggtgatgataatgtcgaagtagcttttgtgattgccgatgtacagaacagcctcgtcctttggaacattttcttcgccgataacggtgactttggttccacagatgaacagaatgacgcgaaacgcccactgcaccatgcgcagctggctgatgtcggcagccttacggttgaacttgctgatgatccattcgattccgaggacgggaatcccgatgatcagatagagaatggcaaacagcagagcaaggatggctcgtaacataagaaggtcctttccgggcaagcgccccgtagatttttacatagtttttattataaatcctgaaaagaggaaacacaagacgcggaaaagagaattcgcaggcatatttaaaaaagacgcggcatatactttggatagaaccgaaaatttgggggactgtcagatgttttggtatgggaagagatggaagaaggggtgtctggtctttttggcagcggcggccctgcttgctgccgggtgcagcattgagacgacaaacggagcgaaggttgccgatcttgactatgagattgtggaggaggcgcagataccggaggaagtgaaggctgtgatagaggaaaaaaaggcggctgattttaaaacgacctatgaactcgacggggatctgtacatagtgcgcgggtatggagaacaggagacgggaggttacagcatctgcatccgggatctgtatctgacgtcgaatgcgattttgttcgatacggaacttgtgggaccgagaaagggagaacaggtaagcagcggaccgagttatccttatattgtaataaagaccgaaaaacgtgacgaaagtaccatatttgagtgaattttcttgatatttttaaaaaattctccggtttgtttgacaaaaatttagtacagtgataaactaaagcggaatggtattcggtgttaggacgataagaagccggaacagggaggtagacaatgcaacaggcagacatccataaggtacgcgcttccgtgtatcagcagtgcggacggaaggtactgattcagcttgacagaggacgcaacaaggtcgacatccaggaaggagtcattcagaacgcatatccgagtgtttttacaatactggtgaatgacgagcaggaagaaaatccgcctcagttactttcattcagttattcggatatcattacaagagatattcggatgaaattatgttaacataaggtatcaggtataatattccccgtattcgaataagatgtttcaaagattcggatatgggggatatttttttggaactcgaaaaagtaaagatacatagaatacagcagaatggcacggcggtcagccagatcacgctggatgatgactataatgtcccggactaccggccggacatcatgaaggttttgaaagaaaatggcgaactgcggtttgacgaggtgaaggcggcaaacaaggcggtgtgggtaaaaggaagcctggtgtttcacattctttaccggtgtgagcagagtgatggaaaaatcagctgcctcaaaggagagattccgtttcaggagaaactcaatatagacgggctgcaggagaacggggaggtacatgccgccggagagatcgaggatctgacagtcggcgtaatcaattcgagaaaattgagcatccgtgcggtggttgtgctgcgtgcctcggcggaggaacaggtgttggaggagtttacgtccagactggaactgccgggggattaccagcagaagacgggaacctggggagcgctcaatctgctcgcatcctgccgggatgtctgccggcagaagagtgagattgttctgccgtcgaacaaacccaatgtgcgggaaattctgtggcgcagtgtagaactccgcaacgtcgaaagccatgtggaggatgggaaggcggtcgtcacaggtgagattctggcggcggtgctctacagtgaggaagaggagagcgagcgcctgcagtggtatgagacgacggttcctctggaatgtgcggccgactgtgacgctgccggggagaattgcatttttaaaatatcggctgtcccgctgtcggcggaactggagatcaagccggattacgacggggaggagcgcattcttgtgctcgaactctccgtctcggtcgatgtccgcgtgtggcgggaagaagagatggaacttctgaccgatctctactcgctccgggaaaaagccgttccggtagtcagggagcggatcggtgagagactccttgtaaaaaatgcggcaaaatgccgggtaacggaacagctggaaattccggaaagccaggagaaaatcctgcagatctgtgcctgcgagggaacggtgcgcctggaaaaatacgagcctgtggagaacggaatccgggcggagggaacgatcacggcggaacttctctatatcacaacggatgacaatatgccgatccagtcggcaagggaaatctatccgttttcccagatccttgagattcccgatatgcagccggacgtggaggcggagatggactgcggattagagcagctgtccgcggtgatgatggatcaggaacatattgagatcaaagcggtgatccagttaaacctgatggcgtttttgccgcagaaaatacagaacatcgaagagattacagaagagcctttagatatggaagaattacagaaccgccccggtctggtgggctatattgcaaaggcgggcgatgatctgtggacgattgccaaggagaatcatacgaccatacaggatattctggaaaccaacggctggacggaaaaaaatctgcagccgggagatgcggtgctgatcgtcaaacagataggataaaggtactatttgcacagatttgcttgagtaatagaagacgctctgttatactaaagtggttatgagtgttattttttgaaagaattttgaaaacagggagacaaaagatggatcagaatgagaacaaaaattacaatttagagaacgacccgggacagacacagctgggatctgcgggggcagagaatcagcagggaacgcaggatgtgtacggtcagccgggagcacagggtgcatacggtcagccggacgtggcagcgaatagcggaatgacgcagccggatgcccagccgggagcgaatgcttacggccagccgggaaacggttatggacaggaaagcgcaggtcagccttatggacaggagaatgcaggccagccttacggtcagaactacggtcaggcagaaaatgcgaacggccaggggaatgtgagccagccttacggtcagcagaattacggagagcagagcacgaacggccagggagagtattcttacggacagaataacgcctatggacagaataacgcctatggacagaataacgcttacggacagaataatgcctatggacagcagacgaacggtcagcaggcgtatggtcaggcgaacggccagtatgcgggaaatgcatatgccggcgtaaactatggcgaggcgacggtgctcaacgacgagaacggtcagccagtgaagaactcgttcggaatgaagattacattctccatccttgagattctgtgctgctgcggatgcaacctgattaccatgattatgggtattatcggatgcgtattcacgagcaaggcgaacagtgcctacaagtccggagatgtgcaggagtataagcgcaacagcaagtcggcgacaatctgcctgtggatcggttttgcgatcgcactggtatggctggtcttcagcattattttcagcgtactttacagcaacgacatcgaggatgcgtttatggaaggatataacgaggccgcaggtgtaagcgatgattacgacacggatgatttcatgggtgattccggtgatgaagagtacgacaccgacgattttcttgccgatgacagcgaggatacagaggatgccaaaacggcagctccgcttgacgtgacagcaggggatgcgttcgacagcggagacattaccgtcaacggtatcctggtgcagcttcctatgagctacagcgatttcaaggcactcggtttttccatcgactccgaggatgaggagtatgtatccaacaagaatgaatattactatccgacattctacgatgcacagggaaatgaactgggagaggtgtacattggaaatgtaaccgacgatccgcagacacttgcagacggaacggtgttcggcttctcattcaccagcatggactacaatgacgatctggagatccttctgccgaacggtctgacaaaggatgcggtcaacgacgactttatgactgcttacggcgagccggattatgagtatgagtcggataccggcgactaccagtcttatcagtggtacagccacagcgacacctacgaggatatggatgaaaactccatttccgtaacattctatgatggcgagctgagcgatctggaactgatgtatatcggatgggattgatctgatttccgaaaaatcgaaaaattatggaaactgtgacaattttataaggaagtatgatataatcaacgggtatgataacagagtcatacccgttttttgtacgcaatgaaagataattcagatatttgggatggagataccgcatgagacattttaagaaacgtgttctggcactgcttctggcgggagcagtcggaatcggaaactatgcgtctgtgtctgcttcggcaatcaaggatgcacaggataaaaaggatgaggcacagcaggaactgaatcaggtgaaccagcagattcagaatatccagtcggcgcagaacagccttcaggcagagatgaataattatgacaatcaactcatgagcctgcttaccgatatggacatcctgcagagcgatatggatacgcaggagcaggagatcgaacaggcaaacgcggatctggaaaatgcgaaagcggaggaacagcagcagtatgacgccatgaagcagcggattcagtatatgtatgagaatggagaccagtcctttttgacggcgttagtcggcgcggacagcattacggatcttttgaaccgggtggaatatgtctcggacgtctaccagtatgaccgcgatatgctgacgaactatcaggaagtggtgcagcaggtggaagatctgacggcacagcttgagagtgagatggcggagatggaggagcttcagatcagctatcaggagcagcagagttctctggagcaggtgattgcgacaaagcgttcggagatggcggattttgacagccagcttgccaatgcacagagtcttgcaagccagtatgcgcagacgatcaagcagcagaaccagatcatcgcgacggagaaggcaaaacaggcggctgcggaggcggcgaagaaaaaggcggcgcaggcggctgctgcggcaggaacgaccggcagcaccaccggaacggatgcctcgacagccggcaccggaacgacctcgaatacgaccggaaataccgcttcgacagggacggatacctcgacttcgggcagcagtacctccggcagctcttccacaggtctgacggacggcggactaaatccgtcctacacgaccggagtcagcggcagtgacgtcgtgtcctatgcgagccagtttctggggaatccctatgtccttggaggtaccagcctgacatccggaacggattgctcctattttgtcatggcggtctaccagcattttggcatttccctgccgagatcttcctattcgcagagcggctgtggacaggcagtcagctatgaaaatgcgcagcccggcgatattatctgctatccgggacatgtggcaatctatatcggcggtggacggattatccatgcgtccaacccgagaaccggcatctgctacggaaatgcaacctaccgtacgatcacttcggtacggcgtgtgttgtaggtttgtattttcaaaagcaaaatgctataatctggatagaaatgaaataagagatggaggaataaaaaatgcagttcaaacagttacaggatgatatgatcgcagcaatgaaggcaagagacaaggtgcgcaaggatgcaatctccacactggtgtcggctgcgaagaaggtggcaatcgatgagggctgccgcgatgacattcgggaagaacttgtggaccgggtcattttaaaggagatcaagtccgtgaaggaacagatcgatacctgcccggcatccagagaagatctgcttgcagaatataagacgcgctacgatatttttatggaatatgcgccgaaaatgatgtcggctgacgaggtggaggcgtttatcacagagaagttcgcggacgtggtagcaagccacaacaaaggacagatcatgaaggctgttatgccggaactgaaaggcaaggcagagggcagcgtgatcaatcaggtggtggcagggctttgtcaggcatgagacagaaattaagatttactgctgttctggtcgttctggtcatcattctggggacagcatcctaccgcgaacagggaaagcggcagaagctgtcatttccggaatcactggatcttgtggtggtgacggtggacgggaagacggtaactctgcgggagatggcattttatatcgcatatgaggaaggcaatatggaagatgcggccatcatctataatccggataatacggacgaatactggcagctgtatatcaatcatacgttcctacgggagcaggcgaaacagacagtggtggatatgaccattcatgatacgctgttttaccagatggcaacagcagagaaaatcacgctctcagaggaggaggaacagtatcttgccaatgatcagcaggatttttggagtgaccttaccgaggagcagagagcgcgcctgggtgtcgatgaggaaacgattgatgcatccatgcgaaaaatggcgctggcgcagaaatatcagagtattcttgcggagatggaacaggtcgattacgaggattattccatcggcggcacggaatacgaaaaacttctggcacagcatacctgtgagttagacgagactacctgggaccgcgtgccgttcggcagcatcacggtagatcattgaacaaagagggaaagacagagattttccattgcgtgaagcaggatatgcgccgatatgtgaagaaagcatttgcggcaggcagaatataatataaaaaataaaatagagaagagaagaagaatatgtcagtaaaaattggaagaaatgatccgtgctggtgcaaaagcggccggaaatacaaggcatgccatcaggcatttgacgagaagattgcagcgatcgctgcgcagggacatatcgtcccgacccatgacattatcaagaatgcagatcagattgcagggattaaggagagctgcaagatcaatatcgcggtgctcgattatattcaggagcacattcatgagggcatgaatacggcggaaatcgacaagattgtctacgacatgacgaccagcatgggcggtattccggcaccgctgcattatcagggctacccgtacagcgtgtgcacttcggtgaacgatcaggtgtgccatggattcccgtcaaaggatgtcattttgaagtcgggagatattatcaatgtggatgtttccacgattttgaacggttatttttccgattcttccagaatgttctgcatcggcgacgtcagcccggagaagaaacgtctcgtggatgtcacgaaggagtgtgtggaaaaaggtctcgcagaggtaaaaccgtggggatttttaggcgatatggggcaggcggttcacgatcacgccttcgcaaacggttatacggttgtgcgtgagatcggcggacacggcgtgggactggagttccatgaggagccgtgggtcggctataatagcaagcgcggtcaggagatgctgatggtgccgggcatgatctttacgatcgagccgatggtcaacatgggaaaagtggacatctatgtcgatgatgcaaacgactgggaggtctacacggaggacggacttccgtctgcacagtgggagattatggtgcttgtgacggaggacggtcacgaggttctttgctggtaagcaggaggcaggatgaaaaagctgggaaagaaagcgggaaaagcagcttcgatgaagaaagcgggacacagagcagcgggaaaagcggcttcgatgaagaaggcggggcacggaacgctgggaaaagcagcggttctggcgaacaaggccgcgcaggagaaaaaggcagatgtgccgggcgaatggctctatcttgcaccggagactgtgggcgtgcggcagattgcagacgtgctggaaggaacctgtgagatggaaatctggcaggaagcaggcgtacttgagattatgtacggcggagaagcctccatggacatggaggaaggaaaaatacatccccgggatcaggtgactgcggcatttgcagaggaacatgactgcgacagagtgtatctggtgacattttctgcggaggaatatgaaaaggtactgcctgtaatgcggcacatcttacaggaatgcggcggcatattctgcggcgatacggaagattttaagccgatacttacagagtagaaaagggatgcttttttgctttagtgtattgaaatgataagaaaaaacagctatgatactgttattggcgcagagagaaaaagggcgccggatcatggaggaaatatggacagcagaatttcaggacacacaggattattggcattgattggttcgccggtcggacattcgggttcgccggcaatgtataattacagcttcgagcggctgggactggattatgtgtatgttgcttttgatatcaaggtggaggaagtggcagacgccattgccgccatgcgcacattcaaaatgcgcggctgcaatgtcaccatgccgtgcaagacagaggttgtcaaatacatggatgaattgtctccggcagcacagattatcggagcggtcaacacgatcgtaaatgacaacggcagactgaccggccatattactgacggcgagggatttgtgcataatctgaagaatcacgggatcgatattaagggcaagaagatcacggttgcaggcggaggcggtgccgctactgccattcaggtgcagtgcgcgcttgacggtgcaagagaaatctctattttcaatatcaaggatgctttttttgagagaacgctgaaaacggcggagaagatccgtgcggcggttccgtcgtgcgtggtaaatgtctatgatattgcggatactgcgcggatgactgcggagatcgcgtccagcgatatttttgcaaatgcaacgattgtaggcatgaagccgatggaaaatgagagtgtggtaaaggacacttctgcattccgaccggggttagtggtggcggatgccgtctacaacccggaggagacgagattgctccgggaggcgaaggaagccggagcaacctgtatcggcggcaagggaatgctgctgtggcagggcgtggctgcctttaaactgtataccggaaaagatatgccggtcgaggaagtcaaagagcgtttttttagctagaaaggtgaaactgcggcatgaagaatttatatctgatcggctttatgggcgctgggaaaagtaccattgcgagagcgcttgcgaaaaaatgtccgtcgaagcgaatcgagatggatcagctcatcgaggaacaacaggggatggcaatcacagatatttttgccgcacatggggagaattatttccgcgacctggagacagagttgttgcggtctttttcggagagcacaggatatgtggtatcctgcggcggaggcagtgtactcagggatgagaatgcggcgctgatgaaggagaacggttgtatcgtgttccttcgggcgacgccggagacgatctacgaaagagtcaaggacagcacgaaccgcccgattttaaacgggaatatgaatgtggaatatatccgggaactcatggagaagcgccggccgcgctacgaagcggtggcggatatctgcgtggacacggacggcaaggacgtggatgccatcagtgaggagatcctgaaagcggtagaagacagatcataagaggggcagcgggagatgaattttgagtttataagagagtgcaggctggagtcggacgagcttcaggcgatgtatgacaatgttctgcaggaactggagcgcgcggagcattattattggagaaaaccgcaggaatgcggcatcattctgcgccagacaacagagcggatctgtcgtatctataatacatattatcaaatcggctatccggggaacgcttcgctggaagagtttttgtgttatacggacgaaaacgagcacaacgtgatggtgagccgttttctgagcgtcgtccgcaaggagcagcgcgaccggctgaataagctgcgtgtgctgggggatgactgtatctggggcgaggaggcaccggatcaggggatgacttttgaagaccgcatggggcagaatgcaagacatatgatggagaccatgatggaggtcaccaaggatatgtgcgagaagatcaacaagagggacgatgtgtttgacgagttcttcctcgaggaggctctgccggagacgaaggaagaggcaggaaaagaggcacttgccgctgcggagataacaaccagtgcagagaatacgaaaaaatctttgtttgccagaattttccacaggtgaggacaaatgaaaaaatcagtatcgatcgtttatggagtgctgcttgtcatcggattcattctgatggcgttgagctttgcgtttgcaggtaaaaagaatacaagctttgcggaggattccagacgaatcgaactgcagcccgatcgcgtggtggaagtgagtgaagatgtcagggagtattatttcgacagtaatcagatgcagtcggagttttcggaactgacattttttagcgtacatcagtgcgtggaagtgtatgcggacggcgagcagatttattcgctggaaaagagcagtacggtgttcgggaggacgcccggaaccggatggaatacgatccagctgcaggagggcgtgaagagtttcagtgtgcggatcgaggcggtgtacccggcagtgcgggatcatgtgacgaggttctatcaggagaatgacggacagatggtctatcagacgatgagaggatcggttccggagatcatggtcagcacagttgacggagcgatcggtattatgctgctcatttattatgcaattgcaagacgcaaagtaaagatgggaccgggcatcctgtattttggcatttttaccctgatgatgggaatgtggtccatgaatgaggcggagctggttgcctacatggtaaaaagccggacggcggcctcgtacgccggttatatgctgattatgctgatgattgcgccgtttgcagcatttttgcaggagttctccgaggtggaggagaagtatatatcaaatattatctgcatctgttcatttgcgaatgttttagtgtgtaccgtactccacatgacggggatctgcgagtttaaaaatacggtattttgcacgcattttctgatggcatgtgacctgctctatctgctctatgtgatcttgcagcgttaccgggcgcgcggaatggaccggcgggtacgtgtctgtatctggggacttgtaattctgctagtgtcttacgcggtcgacatgtcggcgtactacatcggatggagaagaacggatgtgatcggcagatttggattcctgttgtttatctgcctgctggcgagagaggcgactgcggtgtcgatggagaagattgatgagggacgcaaggcggagatctaccgggaactggcggagcatgatatgccgaccggactgtacaaccgcaacgcttatgatgagtgggcgtcggaaaatgccagagaccgagagacggcgattgtaacgttcgatctgaatgatctgaagtactgcaatgacacgttcggacatgcggcgggcgataagtatattcaggatgcggcaaagctgatcgcagaagtgtttgaacctgccggggtgtgctaccggatcggcggggatgaattctgcgccgtgatccgccatgccagaagtgagtgggtcgaggaacgtctgcgcagactggaatgtctcgagcggaaatataatgaagggaaaacggacgtcccgatgcggatcgcttacggctacgcgatctttgacgagcagtatgataaaaatatggaagagacaaggaaccgtgcggatgtgaagatgtacgagaaaaagagagcgatcaaggcggaagagagaaaatgaaaaaatgcgggaattcccgcattttttctgctgtagtcagaagttgcttccgttccagccccagttgtcagtcgggaagtatgccacgtagatgtggtcggcaggaatggaaagttcgccggagagcagatggcagagctttccggtcatctggctggtgcctgcagcggacggcgtgccgaagcttttgacctccacataagcgacagcggcagaatccccctgaaagaacaggctggcattgtcctcaaaaccagtcataacccagttctctcccttgccgagacactccctggtaatgcggcagatctctgcggtcagggaatcctttttggatttgctcagggaaacggtggttttcgtattgataaatggcacggcaatatcctcctttacatctgataaagatagtatatacgaaaataagcctgcatacaatgtaaaaacaagtattgcaggggatttcgtttgaaaggttatattgaggaaagagctatggagattgccagatatatcattgacaataacacgaccgtgcggcaggcggcaaaacatttcgggatcagcaagagtacggtacataaggacgtcaccgagcgccttgcgcaggtcaacccgtcgctcgcggcggagacgcgcaaggtgctggacatcaacaagtccgagcggcacatccgcggcgggatggcgacaaaggagaagtatctgcatcagcatgtgtgaaaacgcagaagcatttgacggcatgaaaacgtttttatataataggagaagataacggcaggatagatggaggataagcgcagatgaagaagatagcgttgatcatggatggatggaagcgattcttcacatatgcatggcccgccggagtgttggagcgtatcagagagacgaatgaggacgtgaatctgtatattttcaacagttccggagactggagcagggatgaggattacaatatcggagagtacaacatctatcggctgccggacttaaacgatttcgacggcattattgtagatctgaacaatatccgctattccgaggtgcgggagtatgtgatctcctcggcaaaggccaccgggaagccggtgatttctattgcaaatgagattgcggatttttactatgtcggtattgacaactattccgccatgcaggaaatagcggcgcatctctatgaggtgcataattgcagacgcttctggtatgtcatgggaccggacgataattacgagagcaaccggcgtgtggctgcgttgcgcgatttttcagagacacacgggattttgtgggatgccagggatctctactgcgagagttatgaatacaagtgtggagtgcatggatttgaaaaattgctcacgctgcacgggaaacttccggatgccattatctgtgccaacgataacattgccgtcggcgtgtgtgagacagcggcagcccacggttacaaggcacccgacgattttctggtgaccggattcgataattttgacaaggcgagctattattcaccgcacatcacaacggtcggacatatccgcgagcaggtgggataccactgtgcggatattcttctgcggctgtggaggggcgagatggtaccgcggtttaattatacggggcaccagtgcattttctgggaaagctgcggctgcgacgccggcattgcggtggatcaggcagaacattccagggcgcagattgtctatggaatcgagacggacgaatttgaggagcaggtgctttcgctggagtatgaattgttgcagtgcgagacggtgcgtgagatgtcgcgctggattccgaaatgtattccggctatgcggtgtgacgcgatgtatctgatcatggatgagcacatgaatgatttccgggaattgagcgattattatgacagacatctgattgaggatgaagagttctgcgtgcacggttatccggagaaaatgcagatggagttcgcctatgaggacggtgtggtaaaagagagcgaggagacggtcgtggaggggattttcccgaccttcgattacacggagggcggaaaagattttctgtttctgccgcttcatttccgggaacacacggtgggatattttgtcatccggaatgctgtgtatctgatggagaagcagtatctgttccaggttatcaacgtgctgacgtctgcgatggagaatctgcataagaaggagcgccttgcctatctgaatcaggtgctgtcagaactgtacgtgaaggacgccatgacgggaatgtacaaccggctcggttaccagaagctggcgtgtcgtatgtttgagaaaaagaagctgacgggggagaatctttcaattattttcatggatatggacaggctcaaaagcatcaacgatgaatttgggcatatccatggggactgggcgatcaagacgattgcgtcggcgattttaaaatatattccggagggagcggtcgcggtccggagtggcggggatgagttcctcgttgtgctggagcagactgcggatgcagagatcgggaagatcatcggagagatccgggaggagatccgggaacgttcggcggagatgaaactgccgtttccgctgacggtcagtgcgggatgtgtccacacggatatgacgaccgtgcgcgatctggacgactacgtgcgtgaggcggatgctatcatgtatgaggagaagaccgcgaaaaaggcgaaccgcacctaagcaggatgaaaaggcttccaaccgggcaggggaaaagaataagaaagtcagaaggagataccggcagatgaaaatcgagcgtgaacgggtcagagaaacattccgggagtatacggatgcttatgatgcgaccgatgagaaaataaaattgaaaattgaccacacttaccgggtggcggaactgtgcgagcggatcgcgaaggcagagcagatggagaagacagaggttgatctggcatggcttcttggaatgctgcacgatgtgggaagatttgagcagcttcggagatatggaacattcagtgatgcagattccattgaccacgcggcactcggagcggatattctgttcggtggtccgctgtctgcgggggaaggtctgatccgcacgtatgtggacgatgcggcggaggatgaggtgattgagactgccataagagtgcacagtgcctaccggattccggaggggcttgcgccgcgcacggaaaagctgtgccatatcctgcgggacgccgataagatcgatattctccgggtcaatgtggatgtgccgctggaggagatttataataccacgacggaggaactgcgcaatgcagccgtcacaccggcagtgatggatagcttttacgaacatcacgcgacgctgcgcagtatcaagcgcacgccggtggatcatgtggtggggcatatttcgctggtgtttgaactggtatttccggagagtgtgcggattgtaaaagagcagggctatctggaaaagctgctgcattttgagagccgcaacgctgtgacaaacgcgcagttcgcagagcttcgggcggagatggagcgctatcttaagggaaggtaatgtctgctccgtggtttggaaaaatgagcgcagccgcgcagtccgcggcaaagagcagcagaagcagggtgtttaatccaaggcgcactttgggggtgagtcgtttccagagcctggtgagcggcgcctccagcacacagatccagagcacgcccgcgatgccgaagccgaccgccgcgtacaggcagatatagccatgaaaatgaaaaggatagccgctgtaatcccagtagcgcagattccagaaggtatccagaaaccatccgatcaggagttccagaccggtgccgatggcagcactgaggaaaaagacgccggccgggtggattttttttcgcctgcatcccagcagcagatagaaaagcactgcgccgatgccgtagaccggaagccacggcccgtagaggaagccgcggttggcaaaggttttgtcccgatacaggaagatggcaacctcccagagaaacccgccgatcgagccgagaaagaagaaataaatctgctgggagaggaaaaacgatataggagtctgctccggtgcgcagagtttggaaaaatccggaagacggtcatgttttttcatggagatagtataaccggaacattgaaaattattgaattgtgaaatggtggaaaatatagaaatgcgccttgtaaattgcgggagcgtatcttataatagtagcaattgagcaaaccgccctttgcggcggaaaaacatcaggaggaaaagagtgtggaaatgaacaacaatttttcacaggaaaaagtcattgtcatcgactttggcggtcagtacaatcagctggttgccagacgtgtcagagagtgcaatgtttactgtgagatctattcctaccgtacagacatcgagcagatcaaggcgatgaatccgaagggtatcattttaaccggcggtccgaacagctgctacgagccggattctccgacgtacacgaaggaactgtttgaacttggaattccggttttgggactctgctacggcgcacagcttatgatgcatgtgctgggcggaaaggttgagaaggcaccggtgcgtgagtatggcaagacagaggtgtttgtcgatacgacatcgccactttttggcgatgtgtctgagaagacgatctgctggatgagccattttgattatatttcaaaagttgctccgggattttccattgcggcgcacacggcagactgtccggtggcggcagcggagaaccgggagaagaagctttttgcaatccagttccatccggaagtgcttcacacccaagagggcactaagatgctgcacaatttcgtgcgcggtgtctgcggctgtgccggaacctggcgcatggatcattttgtggagcacacgatcgaggcgatccgcgagaaggtcggtgacggcaaggtgcttcttgcgctgtccggcggtgtggattcctcagtcgcagcaggacttttatccagagcgatcggcaagcagctcacctgcgtgttcgtggatcatggtcttctgcgcaagaatgagggcgatgaggtggagagcgtatttggcccggacggtcagttcgacctgaattttatccgcgtcaacgcacaggagcgctactatgcgaagctggcaggagtgacagagccggagcagaagcgcaagatcatcggtgaggagttcatccgtgtctttgaggaagaggcgaagaagatcggtgcagtggatttcctggcgcagggaaccatctatccggacgtcgtggagagtggacttggcggggaatccgcagtcatcaagtcgcaccacaatgtcggaggtctgccggactatgttgatttcaaggagatcatcgagccgttgcgcaatctgttcaaggatgaggtgcgcaaggcaggtcttgagcttggcattccggagaacctggtattccgccagcctttcccgggaccgggactcggcatccgcatcatcggcgaggtgacggcagacaaagtccgcattgtgcaggacgctgatgccatctaccgcgaggagattgcaaaagccggactggaccgttcgatcggtcagtattttgcggcgctcaccaatatgagaagcgtcggcgtcatgggagacgagagaacctatgattatgcagttgcactgcgtgctgtgaatacggtggatttcatgaccgcggaggcggcggagatcccgttcgaggtgctgcagacggtgatgagccggattatcaatgaggtgcgcggggtgaatagagtattctatgatctgaccagtaagccaccgggaacgattgagtttgaataacggactaaaatgccgaaagcctgtatttatgcgggtttccggcatttgttttatcaaatggctctagtttggctctatttgtgggcgcaataatggcaagaaaatatatgaaatctaataaggagcattatatgacgaaagtgaatttttatgatagtgttaatgattcaatgctgaagtttgcagttattattgccagacataatggtaaatgggtattttgcaagcacaaggaaagaaatacatgggaggcaccggggggacatagagaagatggtgaggatattcttgaaacagccaaacgagaactatatgaagaaacaggggcaataacttttgatattactccaatttgtatatattctgtgactgcaccagataatttcgatggaatggagacttttggaaaattattcttctcagatatacatacatttgaaaaagagcttcacagtgaaattgaaaaaatagtaattatggatgaactaccgattaattggacttacccagaaattcaacccaaactgctggaagaagcaaggaaaagaggattttgcccaaaaaggacgaaataaaatggctattttttgatgttggatcgacattggttgatgaaagcaaagtttatgaagacaggatgaaaaggatagcggatttatcaggtttaacttacgagcaaatttataaatatgccatgtcgttttataaagaaaacaaaaaaggagatttagaggtagcaaggcaattgggggtgaaattacctaaatgggaatcgcaatacgagaggctgtatacagatactaaagattgtttgaaaaagttaagtagaatttataaaattggtgtaattgcaaaccaatcattaggaacttctgagagattagaaaatcttggagtacgaaaatatcttgatttgattatcgcatcagcagaagaaggcgtttcaaaaccagataggtgcatatttgaaattgcattggaaagaagcagttgtaagacagagaatgcagtcatgattggtgaccgtattgataatgatattgtacccgcaaaacagttgggtatgaaaactatatgggtaaaacagggatttggaagtttgtggaatataacagatgagagtgaaaaagctgatatggaaattaataacttatctgatgtattaaaatatttataggggatgagtctataaaataagattcaaattacaatattgcagaacatatgatatatgttagggtactctttaaggaaagtacccatgacagggcgttaagtgtctgggggtgcttgcttagcgccgatgacggcttatgagatcatttcgattttcattgggatattagcattgttgatgtcctttggtagcttgattatagcgttgcttgcctttctcgataaagagaaaaacttttcgaggaagagcaggcgaaaataaaaatgcctatcctctctgcgaacaggataggcggtgtccttaaggacattcattttcacatatatggcaggcttttaatgaacttgtagaaaatggacaacttatttcaagttcggaaatatttgaagaattaaaagatgatgatattgtaaaatgggcaaaggaacacaaagatgcttttttgcctttatcaaaggaagtacagttaaagactacagaaatattacaacaatttccacaaataataaaaattcaaacaaagggaagctcaaatggagatccatttttgattgcaacagctattttagaagatgggattatagtaactgatgaaggaaacaagaataatggaattccaatggtatgtgaatcattaggtatagagtatatgaaacttaatgatatgttagatgaggtattggagtaatgaattagaggggagagatccttctcttttttgtttgtattattccgataaacgatgtataatcaaactagttttatgtttctacttatgtatgattttgaagaggtaagattatggagtatttaacgactgtggaattatcagaaaggtggaatatcacttcacgtcgaataggtgttttatgtgcagaaggaagaattgaaggtgcaataaaaaaaggaaaaacatggttaattccttcagatgcaataaagcctgctgatggacgatacaagaagaagtcagaaaagtaagatgtaatacgaaatagaatttataaatatatgagaatatataattaaatgcagagggggtactgatatggcatttgattttgaaaacgcaaatgaagcacagagaagtgctatttcaacaacagatggtccgttgttgattattgcaggccctggtacagggaaaacatatacattagtaaagagaattgtttatcttataactgaaaaagatgtgcttcctgaggaaataatgattgctacatttacagaaaaggctgcgaaagaactgattacacgtatcacaaatgaattgtatgcaataggagtatccgtaaatctgaatgaaatgtatattggtacttttcattcaatttgtctgagaattcttaaagatcatcttgaatatacaaggattaagaaaaattataggatgctggataattttgatcaacagtatatggtgtttcaaaagattaatagatttaggaacttaccttattttgatgttatatttgataaaaagcaaggagcttggagacaagccggagaaatagttaagtatgttaataatcttgctgaagaattggttgatattgatgaaatgcagggagacgcggatgaacatattgtagctgttgcaaatattatgaaacagtacaatatcttgatggaagatgagaatttaattgatttttcaagtattcaaacagaagcatataaattattaatcgaagaaccaagtatattggaagaaatacagcagaaaattaaatatgtgatggtggatgaatatcaggatacaaattacatacaggaattacttgtgtttttgattgccggaaaaaataaaaatatatgtgttgtgggagacgatgatcaaggtttgtatcgttttcgaggagcaacaataagaaatatattggaatttccaggccattttgcagaaggagaatgtaagcaggttaaacttgttacaaattatcgttcagagagacaaattattgatttttacaataagtggatgagcacaacagatggtagagcatatgattttatgtggaagaattttaggtttgagaagaagattgttccgccggaagggaaaaaggctgctaaagtaggcgttattaaatgttcgggaaaagatttgttagatgattggtatgaacaagtgtattcatttattacacaattaaaaagtagtggtgtactaactgattacaatcagattgcagttctttgcaagtctgttaaaggggataaaatcataggtatggttgaatatcttgaggaacatggtattaaagtttattcacctcgttcggaaatgttctttgaaagaaaagagataaaacaggtaatagggtgtatgatcttatgtttcccagagtatgttcgtaagttacaacaaagagatttttcgtatgattttgaaaatctctataaatattacgatactcaatgtatagctgctgcaagagagctcattttacagtatagagatacattgggtaaatggattgcagagaagatgcataaacacgctaatctaaaaaaggataatgcagattacgcatttacaggattactgtatcagttattgcagtttgaaccatttagtacatacttagggatagatatgaaatcaggggtgatagatgaaagacctgcaagaaacttatcaattttatcgtcaattttgggaaagtacgaatatctacatcggatagatgtcttcacggaaaacaatattatagagtcggtagaacgtttttttaatatgtattttcgctttttatttgatggaggaattacagagtatgaagatgattcggagtatgctccgagtgggtgcgtttcatttatgactatacatcagtcaaaaggaatggagtttccaatagtgattgttgattcattaaatggaacaccgagaagtagtggaaatcatttgctagaagaaatagaaaataaatatttccatagaaaagtttttgagacgagggaagatataaaattttttgatttttggcgattatattatacggcattttcaagagcacaaaatttattggtactctcttgttgtgaaaagaaaggtcatggagccacaccaagcaaatattttgaagagtgctatgagaagctacctgcttatgaagatgtaaatctttctgaaataaagttagaaaaggtaaagcctgtaaatataaaggatacatattcttttacttcgcacattgctctgtatgagaattgtgcactacagtataaatttttcaaagaacttggatttacgcaggtaagagtaggtgcaacactctttggaacattagtgcatgagacaatagaagacattcatcgtgcagctatgcgtcatgaagaacagacaatagtgccggaaacaatacgagagtggtttgatacaaattatatgacattatcgaaaagtgagcattcttatttaggacaaccgcagatagaagctgcgtataaacaggttttgaggtatgttgagagaaatcagagtgactggagtcgaattcaagatgcagaggtggaagtaagtttagtaaagcctgattatatattgcttggaaaggttgaccttatcaggggcgaaggtgatacagtagagattgttgactttaaatccgagaagaaaccagatgttttaattgaaacagcggagatgaatcgttataggagacagcttgaagtgtatgctcatcttattgaggaaaagacaggtaaaaaggtaagtaaaatgcatttgtattatacaggtgaggataatggtgtaccaacagtaacatttaataagtcaacggaaatgattgataaaacaataaaagaatttgatgcagtggttgaaaaaatacaaagtaaagattttagtggtagagccaaagataaaaatctttgtgccaactgtgatatgagacattactgtagaagaaaaggagattgctaatggatggacagatttcatttacatttgaacaaagacaaccaataaaaggatatccggagttacactggacagggaaaaggccatatacatcgacacagtattatcctgcacagcttaaggaatcatatggagaacctaaggatggttggatgaataagatattttggggagataatcttcaggtgatgagccacatgttaaaggattatagaggaaagatagatctaatttatattgatccaccgtttgatagtaaggctgattataagaaaaaaattaagaaaaaaggagtagttgtctacaatgataatacatcattcgaagaaaaacagtatagtgatatttggacaaatgatgagtatttacaatttatgtatgagagattcgtgcttttaaaggaattattgtcagataccggtcaaattatagttcatttggattatcataaatgccatcatatacgattgattatggatgaggtttttggacaggataattttagaaacgaaataatatggacatataatggtggagccttaccaccgaaagattggccgagaaaacatgataatttattacggtatgtaaaatctaatacaggttggacatttaatactgagtatagaccatataatgaacagacagcattaagaatgagaagtatacataaaggagttatggtagatgtagatagaggaactccagttactgattggtggacagatataaaagtaccaacaggtccgatgaatcaagaaaaaaatggatatccgacacagaaacctgagaaactacttgaaagaataataagtacacttacaaatgagggggatttggtatttgattgttttatggggtcaggaacaacacaaacggtagctatgaaattaggacgtaagtttattggcgcagatattaatttaggtgcaattcaaactacaactaagcgtttgatttctgcaatgaaaaaacttgatgataaatgttattcaggatttgaagtttataatgtaaataattatgatttctttagaaatccagtagaagccaaagaattaattattgatgcattaggtatccaaaaatttgattcatcaacagtatatgacggcgaattagatggttggatggttaaaataatgcctacaaatcgtattgcaactaaggctgatttagaagaactcaaggctaatttaccataccatacatttgaaaagcgtaaggaagaaaatccgaatggcgtggtggaaaaaattaagattatttgcatgggacatgaggctgatttaaaggcatcgttggaacaggaactttcttcgtataatttggagatagagatagttgatatccttagggataagaaagatttacaatttaagagagaagcagatgccaatgttgttaaagaaaacgatcagattataataaaagaattttatccgatgaaccttttacagaaattaagcatgcagaaagaatcagttgaagattggaggcagttggtagaatctatctatattgactggaattatgatggacagacaatgaggccgacaatttgtgatattcctgcaaaagatgagttggtatctggtatatataaaattccagcttcagcaggtaaaattaaaataaagataacagatttgttatctgagtcacttgagctggaggtatagatatggcaaaagaagttggaatggaatttgccttttttgagttccttcgttcattctatgtagataatagaggaattataagaaataggtatcgtgaaataactaagaaatatctggattacaatgacaaggaaaagaacccagacgcatttttacgaaccccacagtttgaagccttagaaatgtatgtgtttgtaaaagaatttatgaataatcagcagatgtatcagatgtttgatgactggtcaaagagaaatggtgtgtttgcagatagacgattctatgatgaagctgggcagatgacattatatgatgtttattctccaaagcagtatcatgattattttttgcagataaagaaatatgcggaagattatccaaattatatttttgcattaactatgggactaggtaagacaattctcatggctacatgtattttttatgagtttcttcttgcatcaaaatggcctcgtgatgataggtattgtcataatgcattggtttttgcgccggacaaaacagtattacaatcgttaaaagaaatagtaatttttgataagagtaaggttgtacctcaggaatatattggtgtattagatacaaatattaaggtgcattttcttgaagatagtggaaccacattaaatacattagatggttccaagtataatataattatttctaatacacagaaaatcatattaaaggctcagcataaagaaaaaagttctgtagataagttgtttagtgatcagataccaggacaatccgttttggatgatgttcttggaatattacaggaaatcagtaacaacgatgatttgatgtcaaatcaacgttttgagaaacttaccaggctttcacaaatgggtatttatgtagatgaagcacatcatatgtttggagcagacttggagaaggctttgcacgaaaatggtaagggcactagcctgcgtaatactataaatgaattgtctaaggaattatctaagcatggaagtaaagtgattgcttgttataattttacaggaacaccatacgtcaataataagattcttccggaagttatatatgcttatggattgcaggcggcaattagaaataatttcttaaaagatactagtgttattggttatagtaacgtaaaaagcaaagaattcctaaaagctgttattgccgatttctgggcaaagtatggtggaaaagaatatgaaggattagcacctaaaatggctatttttggtgcagagatagcagaagttcgtgatgaaatcaggccagttgttgaagaagtactatctgaattgggaatacctcttgataaaattttagttaatgttggagacgaaaagattactaaatctgaagacataagagattttaacaatcttgatatagttggaacagcaggcagtaagaagcagtttatattgcttgttaataaaggtagagaggggtggaactgtagatcattatttagcgtggctctttttagaagtccaaagtcaaaagtttttgtgcttcaagcaacaatgagatgcttgagaaaaattacagatgaacaactaatggccacagtgtacttgtcaaaagagaatatggatatattggatgatgagcttaaaaagaattttagaactagcatagaggaacttgtagttaagaaggataaaaaacgtaagaaagttcctgtacgtgtgaaagaaccacctagaacattgcgcatgaacagattgcattataaatattctttggaaactaagcattatgatagtagattatcgtttggtttgaaagaaatagaaacagaaaattatgatgcgacaatgtatgttaaagaaggacttacaacttcgtctgttgtgtgtgaaagcaatgttaactatatggttagtaaattagcgtatactgagataacgttggtggcagaagtagcaaaatattttcctgatatcagatgcacagaagttgctaggatactgagggaatcagaagaaggtattgataaaatattagtagctgtcaatgaacataatgatattatttatgataaaattgtgccaaccatatttgaggcattataccgggttaacaaagagattgtaaaagaaaatgttgatgttaaattacttaagaagcctaaagaaggtggatattatgagtttagtggaaatgaggatttgattataatgcagaattcagaggattctgttgttgtgaaaaataaagacaagagttttcacgcagatacctatgtttttgattcgaagcctgagttacaattatttttacagttgcttgcaaatgagcacgtaaaaaaagcctatttcacgggaatgtttactgctgaccagactgatttttatgttccatatattgatccggaatcgaataggttaaggaagtattatccagatttcttagtaaaaatggatgatggaagttatttgattttggaagtaaaaggtgacaatatgatagacgatccggtagtaaaggcgaaaggagcagcggctgaggaggttgcagtagagagttcaatgaaatacgaaatgcttaaaggaacagacattatggaagggaaagcaaagatttagttaaaacgggtctcattcaacctgaattgcaaaagattttatgatggttggatgagccagattgtgaaaggaaactaagtgtatgaacaaagaatggttttcagattataaagagcagatttcattaaataatatgcaagaagcaagaaatgtgatattagataatattgataagactcaaatgatttatcggtatagcagaggtttgaatagggatttgcgaaatttggaaaatcatcaattatggttaagtagtgcatttaatttcaacgatccatatgattgtttagttacagttgattgcggattgaaagccagttatccgaagagccagagaaaagaagctatggaaacctatatgagacagaaaactgaaaataggaaaacagaagcattgagaagttcattatttgttgcttgtttttctgaagttaataattcatttcctatgtggggatattatgcggcagatcacaagggaatatgtttaggatataacctttatgagcttgttaagaaatacaaatgtatgccggtaatctatagcgataaattaatattttacagagaagatagttctgaaaaaaacatattggctaatacattaaccaagtcagatgagtggattcatgaaaaggaatggcggatagtaattaaagatgatattaatatgggaaaatcagggataataaaagattttgttttgccacgagaaatatatattggatgtagacagcaggaaacagtcgctgagaataacaataatcgtatgttacataataaaaaagagaatgagatgtatgctgatctagatgagatacttaaatgggcggagaataactatattgatgtatatatgccaataataactagaaaagaatataaaatgatggatagagcgttacgattgatttagcaagttttagcagaggtggctatatgtcagattttgaagaaaaatatgattatcaggaaattatggtagaagatatttcgcagatatatcaaattgcaaatgattataattcgttctatgatttaccaagatcaggtagaggtgacccaggtgatgaacgaacttacttacaggcattttatagaggacaaagcgattcttcttggaaaatcactccaagtatatgcagagatacatctgtggatgagagtatactggaatctggagatttactatttgaagtaatggcatataatcagcattatatacatgctacaagattaattgactttacaatggatataaatgtagcattgttttttgcttgttgtgaaaatattgaaaaagatgcggctatatttatatggtcatattctccgtatgatcctaaatggacaagaataaagatacagtgtgaacttgttaatgttaaaaagcaacgcataagtgtaagtgaatatgcagagatacttttgcagaaatatccgggattgaaagacaattgtacttataaaaaggatttctatactgatttagtttcttatttggatcatggttttatgattatgcaaccacgcaatccgtatttggaaaatatgagaatacaaagacaaaaagggtgtttatatgtttgtggtgtgaaatttgaaactccgattgataaaatgagaacaagtgttaatgcggggaataatatattgtgcccgcatgagccggaagcgcctaaagaattggacggaggtaattttttggtaaaggtggtcattcctgcaagattaaaaaatgtgataatgaaacaattggaagaaaagggaattacaaaagaagctttgttacccatgtgatgtaaataggcacttgtttaatgtagaaggatggtgagaactatggatataaagcagctaatcggcgaaaccacagattacgataaaaaggttgcacttgagataaagaaacccaaaagctggtgcaagagtataagtgcatttgcaaattgctatggtggtaagctggtatttggtgtggcaaatgatgatgcgttggttggtctttcggatgctgaaggagatgcagaaaaaattagtgagataattaaaacacaccttaatccaataccagagtttgagctttcatttgaaaaagataaagacaagacgtttgttattgtggaagttatgaaagggcagcagacaccatactattatgaaggcgatggacaacttattgcgtttatgcgtattggaaatgaaagtgttccagcaacaccttcacagttaagagagttggtacttcgtggaagtggtgaaagttatgatagtctgaagtcaagatatgattttagcaatatgtctttcacaaaattaaaatcggtatataagcaaagaacaggaaatgcatttgaagatacagattatgaatcttttggtttgattgatgagaaaggcaatctgacgaatgcaggagcacttctggcagatgaatctccggttcgtcattccagattattttgtacaagatggaatggacttacgaaggcatctggaattgtagatgcacttgatgataaggaatatacgggaagtcttgtcacactattacaggcaggaacagattttgtcagaaataattccaagaaagcatggcgtaaggtaggtgacggcagaattgaaatgcctgattatccggatcgtgcagtgcttgaaggggtagtaaatgcattgattcatagaaattatatagagataggcagcgaagttcatatagatatgtttgatgacagaattgaaatatattcaccgggtggaatggtaagtggaatatctttagagggaaaagatttattgaaaatcccatcaaagcgaagaaatccgatattagctgatatattcagccgtttgaaatacatggagcgtagaggcagtggatttaagaagatattggcagactatgagggtcaggttgaatttgatgagtccaagatgcctgtctttgatgcagataatgatgattttacattgactttgtataatttgaattatggacatgattatgtgatgaatgttaatgatactaggaatggcactcaaggtggcactcaaggtggcacccaagatggcactcaagacaaattgcagaaacaaatctttgatatgatagaagaaaatcctcaaatttccacatcagaaatcgcagcaaagttaggtgttggtgtaaggactgtgaagagaagaattaagcaaatgacgaatattgtatatgttggaagtgggtatagtgggcactgggagattaaaggggactaagcaggcatattttatggcaaagaatccaatgtgataatagttcagataagttatcacaaaattaaaaaaggagaatgataaatgaagagacaattgtcacaattgcagagattacttgtggcgggaatatatatttttataattgttatgatagatggattgctaaatgggggaatagcggatatattgaatcagtcggaggctgcatcagtttggtttttctctgggattttattgattataatgggaatgtatgtaactgaaccatatttttcgtcgccaacagacacattatctaatagtatttcgttgatattggttttactagctataacaaatcggcaggaattgaatggttacgttgaattacttgtttatgcagtttgtatgtttatattgagtatttttcatatgattgtaaaaaattataatgaaaaggcaaagaggattagtttttggtgtttaaagcatttaggaagttctaaaacgatgttttctgtggtgtatcttgtctcggcattttcgttttttagagataatacacctatgttattcgcagcgattgctttatggatatgtatggtaccaattggacttgtagaaagtattattgcccaatttagtcagttgatggggataataaaagaaaaagatattgattcgtgtattggagtagctataaaaaattcagagtcaaacttatatacaatttcagttcctaaaacagatgaaaaagaaaaacttgtatcttcaagtagaaactctgtgtatgctgtaaaggtagactctgattcttattgtttggggatagaaacacaaagaaagaaccttattgattcaatttggataagcataatgttattggataatgcagagctggaaattacactaagtgatttggaagatataggaattaacattaattatacggaaaatttaggagctgcacatgttttgaatgaaggaaaaataaaacaatcaattcttgaacagttgaaatcatcaactatttttatggaacgcgatgattttataggatttgttcttcctgaatcgaatgttagtactatcaggtttaatacgtgcaaaatagatgaaatgcgattaacagaaggaacaatagttaaaacacatattgcaggaagtgaagtcctttaccaagtaatcaatggcattacaaagatagctagtaacagtgcggatagcgagtatggatatatgtgtgcagtagcaagaaaattggggcattatgatgccgaacatcatgagataaaacatgttaattggacaccgaaagtttatgagcctgtatacctttgcaaagtaaatcgagatattgatttgcaagaaatagcaaaaacttctattggtcggttaccgggatctgatatgagtatacctataaagaatattaatgctcttgtaactcataatacagcagtattaggaatattgggagttggaaaatcttgtttaacgttcgagttgattaaaaaaattgttgctgctggaataaaagttatatgtttagatattacaaatcaatatgcaagtgataatggtttgtacaaatatattcctgaagcacaaatagtaagtgatttgctgcaggagaaaatagatgaacttgagtcacaatcaatgcgtacaggtacaagtgattcaaaatcttcgtggggaaatgttgagaattttaaaaagctgatggaatcggcagtgtctggatttatggatgctaacaacaaatctgtgatggtacttaatcctgaaaaatatattgttagacaagctgcaactgattttagaattacagagctgaaggatgtatctttggttgaaaaggttcaaattatttctgaaatagttcttaaaaagtgtatggatttgggacaaatagatagggcgagatgttgtgttgtttatgaagaagcgcattcattgactccagagtttaattcagttgtagtaaaagatgataactctcatgcgaatggcactgcaaaagttattttgcaaggtagaaagtacggacttggttgcattatagttacgcagcgtacggcaaatgtaaccaagagtatattgaaccaatgcaatacaatttttgcattaagagtatttgacgatacaggaaaatctttcttggaaaactatattggtagggattattcggatactttgccgacattggaagaaagacacgcaattgctattggaaaaggtatcgggctaaaacaaccagtgattttacagcttaatgatatgaagtatttacaaacgaatgacggagaggaaatagttgagaaaaacgaatgtgtggatgtagaaacagaagaaattacccccaatctataggatttttaatattacaaaaaattaaagtctcgttaaaagagtgatattgctttcaatgagatttaagatttggagagaatacataatatggcaaaaatgcgataaaatcggaatttatggctgattcgtatgagtacaatttcaaatcggtcttatttttgacactgtttgttgagactaacatgagactgaggaggttcaaaatcatggacataagtaaaaaagattggaagctatttcgagaaagattatcaggctggcaggaaaattatatggaaggtcttgttaaagagtatgcaaattttctgaatgatgataaaaagcctgcatcagagaaattctgggaacttgaaaaacggataaaagaagataaacgtcatccgggagttgtcatggaactgaaaaaatcagaggtaatatgggatatcgttcgtctcattagactgaaagtaactacatatgatgatttatcagactttagtgatgaattacagaatgaagtaaaaagaatacttgagatgagcaggtgatacatatggagattggtgcaacaaaagcagttcaagatagactaaaaacaacaaaaattgaagaaagcaaaggtgcttcacttgtgttctgctgggacacacatttgacgaaaataaaaggaagaaatgtcttgtttattgtgaatgccagtaatcgttatacaatagcaatgacagatattgaaccaagaaactggaattactatacaatgtttatccgcagtgtgattcatggcgtgatgcaggaaatgggatactccgaggatcagataggtcagtattttaaaatgtcagacgatacaactgtaacaaaaactcatggtaggaaatcggttggtggcattaacagaatggtaatggatgcacagtattttggtaagaagctggagaaagaagcaaagtatcaatgggaacttagtgagtatctgaacagagatatttgccagccagagggatttgatgcgtatggatatccgagtgaactttttaaattagacatggaacgattagggattgctgctaagagagagccagcaaaggtaattgattttgctcagtacatagaaaacaatcgtggtactaacgattagtaccacaaaatattttcttgctgaaatatcgcttggagattataatttcaataggtggacaagcaaaccgacagaatattattttgtgaatagtaaacaaacctgcaagccaccggaactacacacaataatgaaaaaatgcaatggtactggattggtactaaaaatatgtgaaacgaaaaataatgtgtggaaaaggcataggatatcaatacaaaacagtatagataaccatattgaaataacctaaatcaaactagattctgcgagtttgaataaataggtaaatccctacaaagcctgtttttatgggctttgtagggattttttgatggcgttgggtacgattgggtataaaattttattttgatatattgtgctatactaatgttgtaacaggagtggctgataagatataatgaactctgacgagttcatattcgaagttcctgcggaacttcgaatgcgcagaaaacagcgcagaaaagatgatataataaattcaacagaggaaagaggttatattatgccacaaagttacactcctgaatttaggaagaaaattgtacgccttcatacggaagaggatgtacctgcaaaagcatcactgctgagtatgggctatccaaagccagcatttccaagtggtgcagcgaattaagcaaagaatgtcaagctaaagctcacgaagatcctgatttaccaaatgaaatggaactcatgaaggagaatctccggttacgaaaagaactggaagaagcaaaaaagagaatctattcctaaaaaaacagcggcattctttgcaaaggaaatcgattagaggcttatcgattcacagaacaacatcatattgaatttggccggcgctggtttctcagaaggctggaaatctgtccaaatgcttactataactacctaaaacgcaggaaagctgattgttatacccgtaaatcagaagtacagaatcaaataaaagaagatctaccactcgcacaagggagtcgctggttaccgcagcatgaaagtttatctggaacgtaagtgtcatagtgtaccaatggtgttagagaaagggaaaatggaactttcggagaaatggaaatggactagcggagattattctgagggagagtctttgctggtagaggtgtaggatgaaagaaatctatgaatacaaaaaagcaacgatagaagatatcaatgaactggtaagaacaagaatcattgtccttcgtgctgccaataaactgtcggatgatgtggatatgtcattggtggaaaaagaatcctatgagtattataagcgaacattagaaaatggtgagcatattgcatatcttgtgtatgataacgaaacttttattggtgccggcggtgtcagcttttatcaggttatgccaacatatcataatccaactggtaaaaaggcgtacattatgaatatgtatacggcatcagaatatcggagacaggggattgcatttcatacattagatttacttgtaaaggatgtaaggaaacagggcgtatcacagattgctttagaggcgacagagatgggacgaccgttatatgaaaagtatggatttgtaaaaatggaagatgaaatggagctgaagctgaagcatagctatgtgtgttccaattagaaagtaggtatataatgataaacagctctttaacagcggaatgtaataagatatttaatttttggaaattagaagaatattttacaccatcagattatccggcattggttttaacaataaaagagggaaaacagaatattccgtttgatgcgtattacaatgatcacagtatcagaagtttgccattaaaaagatacaaggctcataatgagtatttgagacagaagaacaaatctgatgagagtttatataatcgagcaaatatttattgtggctgttatagaactaaagattttgttgaaaaaatggctgaaaaatgcaaattggatagggaaaaatatgcggagataaatgaattgacaggacggttttatgctttttctgttcagatagatttagatgggaaaattacagaagagggtttgcaagtcagcccgttcttttacgctgtactttgcatgataaaagccgagggcataaatgttaatattatgcaagaaaatatatggaagctagatgaagaagtaaatgaaatacttaaacaaaataatgtacgaatattggagtttgaagatgtaacaatagtaaaaaatattatatttgataaactgagaattaagtctgaaaatgaaattgggctaaaaagtgcttcggataaagtatatgcgtgcaaaggtttgaaaaaagaagatgaaacaagtgactttaccagtttttatttggacgaaatagaaaatgttcagaaaaactatgagaataatgagaatttgataaaatataccacttcattattggaagaaaaacaaaaaaggataatgatagatagcgatgtttgttccatgaaaaaatggttggaagtagatagatttccaatgggaaaatatccatcaaagttttctccgacattaatgcagcaaatagctataaacatagctatatcagaaaaggatagaaaagaaaaaatattttcagtaaatggaccaccaggaacgggaaaaacaactcttttgaaagaaataatagcttcaaatgttgtccaactagcagaagttttaattaaaaaaggaataggtggtagtaattttgttcctaggaaagttgaatctgcatcaaatgctagttatacagaaaaatattatgaaataccagaagaaatttctaaatatggaattcttgtggtatcaaataataatggagctgtagaaaatgtcacactcgatttaccgaaatcttgcgatatgggaaaggataaaactaggacagattactttgacagagaaataaataaagaagtgtatttttcagcggtagcagataatcttttaggtaaagagggcggtgcatggggattaatatcagctcgtatgggtagaaaatcctatgttacagaagttttagaatcttgtgtattcgctaaaaaaaatgatgcttcggataaagtaacattagatcttgcaagagaagatagtatttcgtgggaggaagctgttgataagtttaatgtagctaaaggaaaggttttgttattaagagaaggcataaaaaaggaccaaaaactcttggatgatttttataaagaaggagagagttttgcgaagagtaaattggatttaaaacagttgctcatagaaaaggagcagttaaatgtaaagttaaatgaggtaagaacggaattagaaagtaatgaacagttgactttagagcaggaagaggaaattaagtatattaaggaacatagctctatttttaagaaactacttatcctttttggaatagggaaaataggcaggcatattgctgaaaaacaaaaatatattgatgggttaataattaagcacgaagatattaaacatagatatagtttggctgtgaaaaatacagaagaagtatgtacaaaaattgaaaagcaatatagtataatctctactttagaaaagcaggtacagatacttgaagaaaaaatatatggagataaggagtctttaaaaaacaaatacaaaaataattttgcggataggaatttctataaaaatattaaggaatctgaggattcgcagaatgcgtgtccatggacatttgaggaatatgatatggcgagggaggcattgttttatgcttcattacaagtgcgaaaagcgtttattttagaatcgccatatataaaaagaaatctgtttgtatatgaagcatataacaatggaaaatacacaatagcagaaaaacaacagatgtttccacatttgtttaattcattgtcagtagtgatacctgtgttgtcttctacttttgcttcggtgggaagatttttaaaacatgctgggaatatgagtttaggtatgcttatcattgacgaatccggacaggcagttccacagtctgctttaggagcaatttatagaacaaggcgggctgttgttgtgggagatccgttgcaagtagaacctgttgtaacaattcctaaagtgttaattgatatactagctgatagtacttgcgtagcaaatgcatataaggtgatcgaaaattcagttcagactttttctgataatataaatgagtttaatggtatgatcggggaacgccaggttggttgcccgttggttgttcacagaaggtgcatagaaccaatgttttctatttcaaatttgatttcatatgacaatagaatgtttaataaaacaaataagaaggaagaatatttgaaaccggaaaatctatttttgataaaaaaatctggatggattaatgtggaaggggaagaaaatggtggtaaggatcattttgtgaaaaatcaagcagagagagtatgccaattaatggaagatgcagtacatatatattcagatttgtttgagacagatgataagatttttataattacaccttttagaacagttgcagaatcaatgcgtaagtttatcattagctacttttcagtaaaaggatatgataagcaaattttgtcaaagtggacgaaaaattgtgttggtacagtacatacttttcaagggaaagatgcgaatgaggtacttttggtattaggttgttcaaataaaagtgcaggtgcaatgaattgggtggtaaagaaagctaatatacttaatgttgcatgcaccagagcaaaatatagaatagcatttattggtaatataaatgattggaaaaatagaaggtacttcagagagtttattccgagtttcattgatataataaatgtgtaaaaaatagacgatatggagtgggagtaggagatattgctatggctgtgtcatataacaaattatgaaaattattagtggataaaaaaatgagcaaatctgatttgcgtaaaaggcagaaattgcgcctgacacgatgaaaaaaatacgtcgtgatgaagcttataaaaaaatcgcaaggcaatggtgtgaaaggcataagattgatattgttgaataaaagaaaagagctgctatgatacccacagaagatattatgccgatagtgaaaaaaacgattgctgcatcaattaaatgtaacacccatcggggatacattggttggagcagctgtgataatatttgtatggatatgcatgcatgccttgatatgtgtgctgagaccttagaaatgcgtggctatatggctgcacttgaggcggctgcatacattttggtatctagcgttaagttagcatctcatgcggatagtagttcgggaatgcttacagatgttatcatgtgtacatacgaactgatagacaaatgcacaaaagaaatcgaaaaagaagacaaacaaatgcgggatcaagcacttgcattaattataaaagaggcaaaaaagagtgtgtttgatggttggactgactggcgctataacctgctgaaaagtgggatttgcctgtgtgatgaaaagagtgcaaagaaacttgaaaaagttttggatactttgttggaaatttcgcgggaggattattttccagaatacacgaaaaaagaagatttgattgtaagatatcttttacatagacatttatatggcaaagagaatacgcagaaggagttatatcagaatattctgataaattaactctgtattatagcgattaaggatgctatggaagagaagaattatgatgaagcagagaagctttgtttagagaaggcaaatgcagaaaatacatggcattatcgtagtggtgatccggaagattggaataatgtgctatatgacatatataagacagcaaacaacagggaaaagcaaatcgcacaggcaaaaaagctgttattaatgggaaatgagaagttctggggtgttttgaaacagatttacagagagtgtggtgcatggaatgagaattacaagagtctattggatgaattaaaggatagcaagcgaactgtttgctaccgcagtgttcttatttcagaaaatgaaaagaagagattacttgaagatgtaatggagaatccgtatgatttgttttattatggaaaatatttggtgaaggaatatccagagcagatatatgagttgtgttataaggaaataagtgaaagctgtgctcaggcaaaggatagacgagaatataagaagataacgaagaatatggcacagcttataaaatggaagggtaatgataccgctaagtctttaattgaggaattgaagcagagatatccaagaaaaccggcattgttggatgaattggagaaggtggagaagaaattgtaattcaaataaaatcaatttggtaaggatagaccattgccctgtcatttgccgtcatctttcgactctcccatgcagggtatgtcttgccctcaagacataccctgcatttgtgttttaaaagctatcatgctaaaatgggatacatagtgacaggcaaaaggaggttttaccatgtattatgtaccggatggcacaaagcagtgcggatattatgaatgtaaaaagtgcgggaatcggtttctgtccttgcagacgatgacgcggattccctgtccggattgtgcatcggaggttgattatgagatcgggccggatgaaacgcttgcggacgtgacagatacggcagtgcttctgcagaaaatcgagggcgaggaggaagtggcgaaaatggatgcgctcttaagtcttgcgattaccggcggagactttaactggatttaagaaaagatagaacgggaagtggatgaaacagataagacacagaacaggagcggtgacagagatggaacagacaacggcaaaaaagaataaatatgagattgatatgtgcaatggaacgattatggacaaattgatttccttctcgctgccgctcatgctgtcgggcattttacagctgatgttcaatgcggtagatattatcgtggtgggcaggttttccggcagccaggcgctggcagcggtgggatcgaccagtgcgctcatcaacgtgttcacgaatctgtttatcggaatttcgctgggggcaaatgtactgacggcgcgtttctatgcggcggggcgtgagaaagaggtgtctgagaccgtacataccgcgataaccctggcactggtcagtggaattatcatggcgctggtgggacttgttttttccaagggagcgctggcgctgatggggacaccggacgacgtcatcggactgtcggcactttatatgcggatttattttctgggaatgccgtttttcatgctctacaattatggcgcggcgattctgcgcgccgtcggggacacaaaacgtccgctgctgtttttgatgattgcgggagttatcaacgc
